US012637664B2

(12) United States Patent (10) Patent No.: US 12,637,664 B2
Luginbuhl et al. (45) Date of Patent: May 26, 2026

(54) PURIFICATION MATRICES COMPRISING AAV-BINDING POLYPEPTIDES AND METHODS OF USING THE SAME

(71) Applicants: Isolere Bio, Inc., Durham, NC (US); Duke University, Durham, NC (US)

(72) Inventors: Kelli M. Luginbuhl, Durham, NC (US); Michael Dzuricky, Durham, NC (US); Zachary Elmore, Durham, NC (US); Aravind Asokan, Durham, NC (US)

(73) Assignees: Donaldson Company, Inc., Bloomington, MN (US); Duke University, Durham, NC (US)

( * ) Notice: Subject to any disclaimer, the term of this patent is extended or adjusted under 35 U.S.C. 154(b) by 754 days.

(21) Appl. No.: 17/800,700

(22) PCT Filed: Feb. 19, 2021

(86) PCT No.: PCT/US2021/018812
§ 371 (c)(1),
(2) Date: Aug. 18, 2022

(87) PCT Pub. No.: WO2021/168276
PCT Pub. Date: Aug. 26, 2021

(65) Prior Publication Data
US 2023/0348863 A1 Nov. 2, 2023

Related U.S. Application Data

(60) Provisional application No. 63/081,405, filed on Sep. 22, 2020, provisional application No. 62/978,616, filed on Feb. 19, 2020.

(51) Int. Cl.
| *C12N 7/00* | (2006.01) |
| *C07K 14/705* | (2006.01) |
| *C07K 14/78* | (2006.01) |
| *C12N 15/86* | (2006.01) |

(52) U.S. Cl.
CPC ............. *C12N 7/00* (2013.01); *C07K 14/705* (2013.01); *C07K 14/78* (2013.01); *C12N 15/86* (2013.01); *C07K 2319/00* (2013.01); *C12N 2750/14143* (2013.01); *C12N 2750/14151* (2013.01)

(58) Field of Classification Search
CPC C12N 7/00; C12N 15/86; C12N 2750/14143; C12N 2750/14151; C07K 14/705; C07K 14/78; C07K 2319/00
See application file for complete search history.

(56) References Cited

U.S. PATENT DOCUMENTS

| 5,283,173 A | 2/1994 | Fields et al. |
| 5,468,614 A | 11/1995 | Fields et al. |
| 6,410,300 B1 * | 6/2002 | Samulski ............... C12N 15/86 |
| | | 435/235.1 |
| 6,582,926 B1 | 6/2003 | Chilkoti |
| 6,703,222 B2 | 3/2004 | Rubinstein et al. |
| 6,852,834 B2 | 2/2005 | Chilkoti |
| 9,616,138 B1 | 4/2017 | Iglesias et al. |
| 10,323,076 B2 | 6/2019 | Ellsworth et al. |
| 10,385,115 B2 | 8/2019 | Chilkoti et al. |
| 10,428,137 B2 | 10/2019 | Schiller et al. |
| 10,633,662 B2 | 4/2020 | Pillay et al. |
| 11,015,174 B2 | 5/2021 | Lock et al. |
| 11,021,689 B2 | 6/2021 | Brument |
| 11,155,584 B2 | 10/2021 | Chilkoti et al. |
| 11,156,608 B2 | 10/2021 | Tsourkas et al. |
| 11,591,576 B2 | 2/2023 | Luginbuhl et al. |
| 11,739,126 B2 | 8/2023 | Luginbuhl et al. |
| 12,162,908 B2 | 12/2024 | Luginbuhl et al. |
| 12,269,847 B2 | 4/2025 | Luginbuhl et al. |
| 2003/0149237 A1 | 8/2003 | Vernet et al. |
| 2003/0194704 A1 | 10/2003 | Penn et al. |
| 2005/0255554 A1 | 11/2005 | Chilkoti |
| 2011/0039776 A1 | 2/2011 | Chilkoti |
| 2012/0121709 A1 | 5/2012 | Chilkoti et al. |
| 2012/0122153 A1 | 5/2012 | Bedzyk et al. |
| 2012/0213781 A1 | 8/2012 | Hilbert |
| 2013/0281624 A1 | 10/2013 | Chilkoti et al. |
| 2015/0112022 A1 | 4/2015 | Chilkoti et al. |
| 2018/0037609 A1 | 2/2018 | Chilkoti et al. |
| 2018/0327752 A1 | 11/2018 | Pillay et al. |
| 2019/0048039 A1 | 2/2019 | Chen et al. |
| 2019/0055523 A1 | 2/2019 | Lock et al. |
| 2019/0282656 A1 | 9/2019 | Mackay et al. |

(Continued)

FOREIGN PATENT DOCUMENTS

| CA | 2012311 C | 6/2003 |
| CN | 104725515 A | 6/2015 |

(Continued)

OTHER PUBLICATIONS

UniProt. 2018. A0A2K5RXA1_CEBIM. (Year: 2018).*
Sun et al. 2017. CN 104725515 B. Machine Translation. (Year: 2017).*
International Preliminary Report on Patentability for International Application No. PCT/US2019/046607, mailed on Feb. 16, 2021, 10 pages.
International Preliminary Report on Patentability for International Application No. PCT/US2021/018805, mailed on Sep. 1, 2022, 10 pages.
International Preliminary Report on Patentability for International Application No. PCT/US2021/018812, mailed on Sep. 1, 2022, 10 pages.

(Continued)

*Primary Examiner* — Michael Allen
*Assistant Examiner* — Carey Alexander Stuart
(74) *Attorney, Agent, or Firm* — COOLEY LLP

(57) ABSTRACT

The application provides fusion proteins comprising an adeno-associated virus (AAV)-binding polypeptide and a polypeptide having phase behavior. Furthermore, the application provides purification matrices comprising these AAV-binding polypeptides, and methods of using the same for purifying AAV particles.

11 Claims, 17 Drawing Sheets

Specification includes a Sequence Listing.

(56) References Cited

U.S. PATENT DOCUMENTS

| | | |
|---|---|---|
| 2019/0328662 A1 | 10/2019 | Chilkoti et al. |
| 2020/0017557 A1 | 1/2020 | Chilkoti et al. |
| 2021/0261626 A1 | 8/2021 | Luginbuhl et al. |
| 2021/0340186 A1 | 11/2021 | Luginbuhl |
| 2022/0010288 A1 | 1/2022 | Luginbuhl et al. |
| 2022/0098248 A1 | 3/2022 | Chilkoti et al. |
| 2023/0099707 A1 | 3/2023 | Luginbuhl et al. |
| 2023/0340426 A1 | 10/2023 | Luginbuhl et al. |
| 2023/0391832 A1 | 12/2023 | Luginbuhl |
| 2024/0002448 A1 | 1/2024 | Luginbuhl et al. |
| 2024/0018202 A1 | 1/2024 | Votaw |
| 2024/0254430 A1 | 8/2024 | Zhang et al. |
| 2024/0317837 A1 | 9/2024 | Luginbuhl |
| 2025/0066759 A1 | 2/2025 | Dzuricky et al. |
| 2025/0171503 A1 | 5/2025 | Luginbuhl |

FOREIGN PATENT DOCUMENTS

| | | | |
|---|---|---|---|
| CN | 105175554 | | 12/2015 |
| CN | 104725515 B | * | 11/2017 |
| WO | WO-2004113494 A2 | | 12/2004 |
| WO | WO-2006110292 A2 | | 10/2006 |
| WO | WO-2013111110 A2 | | 8/2013 |
| WO | WO-2014026054 A2 | | 2/2014 |
| WO | WO-2015130846 A2 | | 9/2015 |
| WO | WO-2016154530 A1 | | 9/2016 |
| WO | WO-2018057847 A1 | | 3/2018 |
| WO | WO-2020037100 A1 | | 2/2020 |
| WO | WO-2021106882 A1 | | 6/2021 |
| WO | WO-2021168270 A1 | | 8/2021 |
| WO | WO-2021168276 A1 | | 8/2021 |
| WO | WO-2021178481 A1 | | 9/2021 |
| WO | WO-2021178483 A2 | | 9/2021 |
| WO | WO-2022178537 A1 | | 8/2022 |
| WO | WO-2023212694 A2 | | 11/2023 |
| WO | 2024015853 A2 | | 1/2024 |
| WO | WO-2025043174 A1 | | 2/2025 |

OTHER PUBLICATIONS

International Preliminary Report on Patentability for International Application No. PCT/US2022/070727, mailed Aug. 23, 2023, 7 pages.

Invitation to pay additional fees for International Application No. PCT/US2023/066363, dated Aug. 10, 2023, 2 pages.

Alberti et al., "A User's Guide for Phase Separation Assays with Purified Proteins," Journal of Molecular Biology, Jun. 18, 2018, pp. 4806-4820, Entire Document; https://doi.org/10.1016/j.jmb.2018.06.038.

Balcerak et al., "RNA-protein interactions: disorder, moonlighting and junk contribute to eukaryotic complexity". Open Biology. Jun. 19, 2019; 9(6): pp. 1-13.

Baou et al., "TIS11 family proteins and their roles in post-transcriptional gene regulation". Journal of Biomedicine and Biotechnology. Jan. 1, 2009; 29: 11 pages.

Brennan et al., "HuR and mRNA stability. Cellular and Molecular Life Sciences CMLS". Feb. 2001; 58: 266-77.

Brise et al., "Comparative structure and function analysis of the RIG-I-like receptors: RIG-I and MDA5". Frontiers in immunology. Jul. 17, 2019; 10: pp. 1-27.

Carballo et al., "Feedback inhibition of macrophage tumor necrosis factor-α production by tristetraprolin". Science. Aug. 14, 1998; 281(5379): 1001-5.

Corley et al., "How RNA-binding proteins interact with RNA: molecules and mechanisms". Molecular cell. Apr. 2, 2020; 78(1): 9-29.

Costa et al., "Fusion tags for protein solubility, purification and immunogenicity in Escherichia coli: the novel Fh8 system". Frontiers in microbiology. Feb. 19, 2014; 5: pp. 1-20.

De Franco et al., "Exploring the suitability of RanBP2-type Zinc Fingers for RNA-binding protein design". Scientific reports. Feb. 21, 2019; 9(1): pp. 1-13.

Dickson et al., "Ribonuclease inhibitor: structure and function", Prog Nucleic Acid Res Mol Biol, 2005; 80: 349-374.

Ehrlich et al., "Isolation of an active heavy-chain variable domain from a homogeneous rabbit antibody by cathepsin B digestion of the aminoethylated heavy chain," Biochemistry, Aug. 1, 1980, vol. 19, No. 17, pp. 4091-4096.

Elbaum-Garfinkle et al., "The disordered P granule protein LAF-1 drives phase separation into droplets with tunable viscosity and dynamics". Proceedings of the National Academy of Sciences. Jun. 9, 2015; 112(23): 7189-94.

Hochman et al., "Folding and interaction of subunits at the antibody combining site," Biochemistry, Jun. 1, 1976, vol. 15, No. 12, pp. 2706-2710.

Inbar et al., "Localization of antibody-combining sites within the variable portions of heavy and light chains". Proceedings of the National Academy of Sciences. Sep. 1972; 69(9): 2659-62.

International Search Report and Written Opinion for Application No. PCT/US22/70727, mailed on Jul. 5, 2022, 12 pages.

International Search Report and Written Opinion for PCT Application No. PCT/US2023/066363 dated Oct. 6, 2023, 12 pages.

Invitation to Pay Fee for International Application No. PCT/US2022/070727 dated May 4, 2022, 2 pages.

Jarvelin et al., "The new (dis) order in RNA regulation". Cell Communication and Signaling. Dec. 2016; 14(1): 1-22.

Kobori et al., "Heat-labile alkaline phosphatase from Antarctic bacteria: rapid 5' end-labeling of nucleic acids". Proceedings of the National Academy of Sciences. Nov. 1984; 81(21): 6691-5.

KUROYANAGI "Fox-1 family of RNA-binding proteins". Cellular and Molecular Life Sciences. Dec. 2009; 66: 3895-907.

Leacock et al., "MEG-1 and MEG-2 are embryo-specific P-granule components required for germline development in Caenorhabditis elegans". Genetics. Jan. 1, 2008; 178(1): 295-306.

Luo et al., "P-bodies: composition, properties, and functions". Biochemistry. Jan. 30, 2018; 57(17): 2424-31.

Luo et al., "The D1 and D12 subunits are both essential for the transcription termination factor activity of vaccinia virus capping enzyme". Journal of Virology. Jun. 1995; 69(6): 3852-6.

Luo et al., "Structural insights into RNA recognition by RIG-I". Cell. Oct. 14, 2011; 147(2): 409-22.

Mazan-Mamczarz et al., "Identification of a signature motif in target mRNAs of RNA-binding protein AUF1". Nucleic acids research. Jan. 1, 2009; 37(1): 204-14.

Mazan-Mamczarz et al., "Post-transcriptional gene regulation by HuR promotes a more tumorigenic phenotype". Oncogene. Oct. 2008; 27(47): 6151-63.

Otsuka et al., "Emerging evidence of translational control by AU-rich element-binding proteins". Frontiers in Genetics. May 2, 2019; 10: 10 pages.

Rehwinkel et al., "RIG-I-like receptors: their regulation and roles in RNA sensing". Nature Reviews Immunology. Sep. 2020; 20(9): 537-51.

Shotwell et al., The potential of engineered eukaryotic RNA-binding proteins as molecular tools and therapeutics. Wiley Interdisciplinary Reviews: RNA. Jan. 2020; 11(1): pp. 1-21.

Shuman et al., "Purification and characterization of a GTP-pyrophosphate exchange activity from vaccinia virions. Association of the GTP-pyrophosphate exchange activity with vaccinia mRNA guanylyltransferase. RNA (guanine-7-) methyltransferase complex (capping enzyme)". Journal of Biological Chemistry. Dec. 10, 1980; 255(23):11588-98.

Simon et al., "Engineered ribonucleoprotein granules inhibit translation in protocells". Molecular cell. Jul. 11, 2019; 75(1): 66-75.

Summerford et al., "AAVR: a multi-serotype receptor for AAV". Molecular Therapy. Apr. 1, 2016; 24(4): 663-6.

Thandapani et al., "Defining the RGG/RG motif". Molecular cell. Jun. 6, 2013; 50(5): 613-23.

UniProt Consortium. "P01730 • CD4_HUMAN", CD4—T-cell surface glycoprotein CD4—Homo sapiens (Human) | UniProtKB | UniProt, [Internet; retrieved Oct. 4, 2023], 11 pages. Available from: https://www.uniprot.org/uniprotkb/P01730/entry.

(56)                    References Cited

OTHER PUBLICATIONS

UniProt Consortium. "Q70AB8_STAAU", spa—Protein A—*Staphylococcus aureus* | UniProtKB | UniProt, [Internet; retrieved Oct. 4, 2023], 6 pages. Available from: https://www.uniprot.org/uniprotkb/Q70AB8/entry.

UniProtKB Accession No. A0A653CGZ9 "Uncharacterized protein" Sep. 29, 2021 [online]. [Retrieved on Sep. 18, 2023]. Retrieved from the internet: URL: https://rest.uniprot.org/unisave/A0A653CGZ9?format=txt&versions=8; entire document, residues 2172-2214.

Valkov et al. "Structure of the Dcp2-Dcp1 mRNA-decapping complex in the activated conformation". Nature Structural & Molecular Biology. Jun. 2016; 23(6): 574-9.

Varadi et al., "Functional advantages of conserved intrinsic disorder in RNA-binding proteins". PloS one. Oct. 6, 2015; 10(10): pp. 1-16.

Vasudevan et al., "AU-rich-element-mediated upregulation of translation by FXR1 and Argonaute 2". Cell. Mar. 23, 2007; 128(6): 1105-18.

Wu et al., "Single-molecule dynamics of the P granule scaffold MEG-3 in the Caenorhabditis elegans zygote". Molecular biology of the cell. Feb. 1, 2019;30(3):333-45.

Zeke et al., "Deep structural insights into RNA-binding disordered protein regions". Wiley Interdisciplinary Reviews: RNA. Sep. 2022; 13(5): pp. 1-20.

Zhang et al., "Adeno-associated virus 2 bound to its cellular receptor AAVR". Nature Microbiology. Apr. 2019; 4(4): 675-82.

Zhang et al., "Divergent engagements between adeno-associated viruses with their cellular receptor AAVR". Nature Communications. Aug. 21, 2019; 10(1): pp. 1-11.

Zhao et al., "Expanding RNA binding specificity and affinity of engineered PUF domains". Nucleic acids research. May 18, 2018; 46(9): 4771-82.

Banerjee et al., "Functions of double-stranded RNA-binding domains in nucleocytoplasmic transport". RNA biology. Oct. 3, 2014; 11(10): 1226-32.

Banjade et al., "Phase transitions of multivalent proteins can promote clustering of membrane receptors," Elife, Oct. 2014, 3: 24 pages.

Barreau et al., "AU-rich elements and associated factors: are there unifying principles?". Nucleic acids research. Jan. 1, 2005; 33(22): 7138-50.

Chaves-Arquero et al., "The distinct RNA-interaction modes of a small ZnF domain underlay TUT4 (7) diverse action in miRNA regulation". RNA biology. Nov. 12, 2021; 18(sup2): 770-81.

Heinemann et al. "Cold-Shock Domains Abundance, Structure, Properties, and Nucleic-Acid Binding". Cancers (Basel) Jan. 7, 2021; 13(2): 22 pages.

Invitation to Pay Additional fees for International Application No. PCT/US2024/043621, mailed Oct. 11, 2024, 3 pages.

Kumar et al., "N-Terminal Region of the Catalytic Domain of Human N-Myristoyltransferase 1 Acts as an Inhibitory Module," PLoS One, May 2015, 10(5): 20 pages.

Maelfait et al,. "Sensing of viral and endogenous RNA by ZBP 1/DAI induces necroptosis". The EMBO journal. Sep. 1, 2017; 36(17): 2529-43.

Manna "An overview of pentatricopeptide repeat proteins and their applications". Biochimie. Jun. 1, 2015; 113: 93-9.

Morgan et al., "Probing the structural and dynamical effects of the charged residues of the TZF domain of TIS11d". Biophysical Journal. Mar. 24, 2015; 108(6): 1503-15.

Rha et al., "The RNA-binding protein, ZC3H14, is required for proper poly (A) tail length control, expression of synaptic proteins, and brain function in mice". Human Molecular Genetics. Oct. 1, 2017; 26(19): 3663-81.

Sachs et al., "RNA single strands bind to a conserved surface of the major cold shock protein in crystals and solution". Rna. Jan. 1, 2012; 18(1): 65-76.

Song et al., "Budding-like division of all-aqueous emulsion droplets modulated by networks of protein nanofibrils," Nat Commun, 2018, 9: 7 pages.

Song et al., "The role of RNA editing enzyme ADAR1 in human disease". Wiley Interdisciplinary Reviews: RNA. Jan. 2022;13(1): 35 pages.

U.S. Appl. No. 18/813,397, filed Aug. 23, 2024, by Dzuricky et al.

Visentin et al., "A multipronged approach to understanding the form and function of hStaufen protein". RNA. Mar. 1, 2020; 26(3): 265-77.

Wang, M. et al., "The PUF Protein Family: Overview on PUF RNA Targets, Biological Functions, and Post Transcriptional Regulation," Int. J. Mol. Sci., 19:410 (2018), 13 pages; https://www.ncbi.nlm.nih.gov/pmc/articles/PMC5855632/.

Xing et al., "Negative regulation of RhoA translation and signaling by hnRNP-Q1 affects cellular morphogenesis". Molecular biology of the cell. Apr. 15, 2012; 23(8): 1500-9.

International Preliminary Report on Patentability for International Application No. PCT/US2023/066363 mailed Nov. 7, 2024, 7 pages.

International Search Report and Written Opinion for PCT Application No. PCT/US2024/043621 mailed Dec. 10, 2024, 12 pages.

Agnello et al., "Hepatitis C virus and other flaviviridae viruses enter cells via low density lipoprotein receptor". Proceedings of the National Academy of Sciences. Oct. 26, 1999;96(22):12766-71.

Daly et al., "Three-dimensional structure of the second cysteine-rich repeat from the human low-density lipoprotein receptor". Biochemistry. Nov. 1, 1995;34(44): 14474-81.

Finkelshtein et al., "LDL receptor and its family members serve as the cellular receptors for vesicular stomatitis virus". Proceedings of the National Academy of Sciences. Apr. 30, 2013;110(18):7306-11.

Mangus et al., "Poly (A)-binding proteins: multifunctional scaffolds for the post-transcriptional control of gene expression". Genome biology. Jul. 2003;4:1-4.

U.S. Appl. No. 19/022,823, filed Jan. 15, 2025, by Luginbuhl et al.

Balu et al., "Resilin-mimetics as a smart biomaterial platform for biomedical applications," Nature Comm, 2021, 12:149, 15 pages.

Bhattacharya et al., "Impact of genetic variation on three dimensional structure and function of proteins," PLoS ONE 12(3): e0171355, 2017.

Bork, P. et al., "Go hunting in sequence databases but watch out for the traps," Trends in Genetics, 12(10):425-427, 1996.

Bork, P., "Powers and pitfalls in sequence analysis: the 70% hurdle," Genome Res., 10:398-400, 2000.

Brenner, S. E., "Errors in genome annotation," Trends in Genetics, 15(4):132-133, 1999.

Christensen et al., "Fusion order controls expression level and activity of elastin-like polypeptide fusion proteins," Protein Science, 2009, vol. 18, 1377-1387.

Christensen, et al., "Predicting Transition Temperatures of Elastin-Like Polypeptide Fusion Proteins." Biomacromolecules (2013); 14(5): 1514-1519.

Doerks et al., "Protein annotation: detective work for function prediction", Trends in Genetics, vol. 14, No. 6, p. 248-250, 1998.

Dzuricky et al., "Convergence of artificial protein polymers and intrinsically disordered proteins," Biochemistry, 2018, 57: 2405-2414.

Dzuricky et al., "De novo engineering of intracellular condensates using artificial disordered proteins," Nature Chemistry, Sep. 2020, vol. 12, pp. 814-825 (18 pages).

Extended European Search Report for European Application No. 19850360.9 dated Apr. 20, 2022, 12 pages.

Fenton et al., "Rheostat positions: A new classification of protein positions relevant to pharmacogenomics," Medicinal Chem Res, 2020, 29: 1133-1146.

Guo, et al., "Protein tolerance to random amino acid change". PNAS, Jun. 2004, vol. 101, No. 25, pp. 9205-9210.

Guo et al., "Rapid and simplified purification of recombinant adeno-associated virus," Journal of Virological Methods (2012) 183, 139-146.

Hassouneh et al., "Elastin-like Polypeptides as a Purification Tag for Recombinant Proteins," Curr Protoc Protein Sci. Aug. 2010; Chapter: Unit-6.11, 20 pages.

Hassouneh, W., et al., "Fusions of Elastin-like Polypeptides to Pharmaceutical Proteins," Methods in Enzymology, 2012, vol. 502, Chapter 9, pp. 215-237.

(56)　　　　　References Cited

OTHER PUBLICATIONS

Heider et al., "Integrated Method for Purification and Single-Particle Characterization of Lentiviral Vector Systems by Size Exclusion Chromatography and Tunable Resistive Pulse Sensing," Mol Biotechnol (2017) 59:251-259.

Huang et al., "Silk-elastin-like protein biomaterials for the controlled delivery of therapeutics," Expert Opinion on Drug Delivery (2015) 12:5, 779-791.

International Search Report and Written Opinion of the International Searching Authority for International Application No. PCT/US2019/046607 dated Nov. 29, 2019, 13 pages.

International Search Report and Written Opinion of the International Searching Authority for International Application No. PCT/US2021/018805, mailed Jul. 8, 2021, 13 pages.

International Search Report and Written Opinion of the International Searching Authority for International Application No. PCT/US2021/018812, mailed Jul. 22, 2021, 14 pages.

Kim et al., "Elastin-like polypeptide matrices for enhancing adeno-associated virus-mediated gene delivery to human neural stem cells," Gene Therapy, (2012) 19, 329-337.

Kowalczyk, T., et al., "Elastin-like polypeptides as a promising family of genetically-engineered protein based polymers." World Journal of Microbiology and Biotechnology (2014); 30(8): 2141-2152.

Kuna et al., "Molecular Size Modulates Pharmacokinetics, Biodistribution, and Renal Deposition of the Drug Delivery Biopolymer elastin-like polypeptide," Scientific Rep (2018) 8:7923, 12 pages.

MacEwan et al. Elastin-like polypeptides: biomedical applications of tunable biopolymers, Biopolymers (Pept Sci), 2010, 94: 60-77.

Merten et al., "Production of lentiviral vectors," Molecular Therapy—Methods & Clinical Development (2016) 3, 16017, 15 pages; doi:10.1038/mtm.2016.17.

Miller, A.D., "Cell-surface receptors for retroviruses and implications for gene transfer," PNAS USA, Oct. 1996, vol. 93, p. 11407-11413.

Monfort and Koria, "Recombinant elastin based nanoparticles for targeted gene therapy," Gene Ther. Oct. 2017; 24(10): 610-620.

Ngo J.T., et al., "Computational Complexity, Protein Structure Prediction, and The Levinthal Paradox," In The Protein Folding Problem and Tertiary Structure Prediction, Merz et al., (ed.), Birkhauser, Boston, MA, 1994, 5 Pages.

Ohainle et al., "A balancing act between primate lentiviruses and their receptor," PNAS, 2021, vol. 118, No. 20, e2104741118, 3 pages.

Pillay et al., "Adeno-associated Virus (AAV) Serotypes Have Distinctive Interactions with Domains of the Cellular AAV Receptor," J. Virol (2017) 91:e00891-17, 17 pages.

Pillay et al., "An essential receptor for adeno-associated virus infection," Nature, Feb. 2016, vol. 530, pp. 108-112, 17 pages.

Roberts et al., "Elastin-like polypeptides as models of intrinsically disordered proteins," FEBS Letters, 2015, 589: 2477-2486.

Skolnick J., et al., "From Genes to Protein Structure and Function: Novel Applications of Computational Approaches in The Genomic Era," Trends in Biotechnology, Jan. 2000, vol. 18, pp. 34-39.

Smith et al., "The challenges of genome sequence annotation or 'The devil is in the details,'" Nature Biotech., 15:1222-1223, 1997.

Sommerfelt et al., "Retrovirus receptors," J Gen Virol, 1999, 80: 3049-3064.

Teschner et al., "rAAV for Tumor Therapy Using Transcriptional and Translational Control of Suicide Gene Expression Purified by a Newly Developed Affinity Chromatography Based on the PKD Domains of AAVR," Molecular Therapy, Pharmacology/Toxicology Studies, Abstract 970, vol. 28, No. 4S1, Apr. 28, 2020, p. 422.

Teschner, K. E., "Optimization of rAAV mediated targeted suicide gene therapy, rAAV manufacturing and downstream processing," Dissertation, Universitat Bielefeld, 2019, 229 pages.

Tokuriki et al., "Stability effects of mutations and protein evolvability," Curr Opin Structural Biol, 2009, 19: 596-604.

Uniprot Accession No. P01130 (Ldlr_Human), Jul. 21, 1986, 40 pages, retrieved from https://www.uniprot.org/uniprot/P01130.txt.

Wells, "Additivity of Mutational Effects in Proteins", Biochemistry, vol. 29, No. 37, p. 8509-8517, 1990.

Wu et al., "Single-step concentration and purification of adenoviruses by coxsackievirus-adenovirus receptor-binding capture and elastin-like polypeptide-mediated precipitation," Archives of Virology (2016) 161: 279-287.

Yeboah et al., "Elastin-Like Polypeptides: A Strategic Fusion Partner for Biologics," Biotechnology and Bioengineering, Aug. 2016, vol. 113, No. 8, pp. 1617-1627.

Extended European Search Report for European Application No. EP21756728.8 dated Feb. 26, 2024, 10 pages.

Extended European Search Report for European Application No. EP21757068.8 dated Mar. 4, 2024, 13 pages.

Gilroy Caslin A, et al., "Fusion of fibroblast growth factor 21 to a thermally responsive biopolymer forms an injectable depot with sustained anti-diabetic action," Journal of Controlled Release, May 2018, 277:154-164.

Guo et al., A novel elastin-like polypeptide drug carrier for cyclosporine A improves tear flow in a mouse model of Sjögren's Syndrome. J Control Release. 2018, vol. 292, p. 183-195.

International Search Report and Written Opinion for International Application No. PCT/US2023/070044 dated Feb. 15, 2024, 15 pages.

Kim et al., "AAVR-displaying interfaces: serotype-independent adeno-associated virus capture and local delivery systems". Molecular Therapy-Nucleic Acids. Dec. 6, 2019; 18: 432-43.

Nikolic et al., Structural basis for the recognition of LDL-receptor family members by VSV glycoprotein. Nat Commun. 2018, vol. 9: 1029.

Ruff et al., Advances in Understanding Stimulus Responsive Phase Behavior of Intrinsically Disordered Protein Polymers. J Mol Biol. 2018, vol. 430(23), p. 4619-4635.

Segura et al., "New developments in lentiviral vector design, production and purification". Expert opinion on biological therapy. Aug. 1, 2013; 13(7): 987-1011.

Velho et al., Divergent low-density lipoprotein receptor (LDLR) linked to low VSV G-dependent viral infectivity and unique serum lipid profile in zebra finches. Proc Natl Acad Sci US A. 2021, vol. 118(18): e2025167118.

Votaw et al., "IsoTag(TM) LV—A faster and more effective purification solution for lentiviral applications", Human Gene Therapy; 29th Annual Congress of Theeuropean-Society-of-Gene-and-Cell-Therapy (ESCGT) Edinburgh, UK Oct. 11-14, 2022, vol. 33, No. 23-24, Oct. 11, 2022, 2 pages.

Kobatake et al., "Design and gene engineering synthesis of an extremely thermostable protein with biological activity". Biomacromolecules. Sep. 12, 2000;1(3):382-6.

Lao et al., "Affinity purification of plasmid DNA by temperature-triggered precipitation". Nature protocols. May 1, 2007;2(5):1263-8.

McDaniel et al., "A unified model for de novo design of elastin-like polypeptides with tunable inverse transition temperatures," Biomacromolecules, Aug. 2013, 14(8):2866-2872.

Sheth et al., "Affinity precipitation of a monoclonal antibody from an industrial harvest feedstock using an ELPZ stimuli responsive biopolymer". Biotechnology and bioengineering. Aug. 2014; 111(8):1595-603.

Wang et al., "Non-chromatographic purification of thermostable endoglucanase from Thermotoga maritima by fusion with a hydrophobic elastin-like polypeptide". Protein Expr Purif. Sep. 2020;173: 8 pages.

Zhou et al., "Multifunctional elastin-like polypeptide renders-glucosidase enzyme phase transition and high stability". Biotechnology for Biofuels. Jun. 24, 2019;12(1): 14 pages.

Kosobokova et al., "Overview of fusion tags for recombinant proteins". Biochemistry (Moscow). Mar. 2016;81(3):187-200.

Hahn et al., "Rapid manufacture and release of a GMP batch of avian influenza A (H7N9) virus-like particle vaccine made using recombinant baculovirus-Sf9 insect cell culture technology". BioProcessing. Jul. 2013;12(2):1538-8786.

Heidari-Japelagh et al., "Elastin-like polypeptide fusions for high-level expression and purification of human IFN-γ in Escherichia coli", Analytical Biochemistry. Nov. 15, 2019;585: 11 pages.

(56)　　　　　　References Cited

OTHER PUBLICATIONS

Kaldis et al., "High-level production of human interleukin-10 fusions in tobacco cell suspension cultures". Plant biotechnology journal. Jun. 2013;11 (5):535-45.

Chen et al., "Quick purification of recombinant adeno-associated viruses with the receptor-binding capture". Acta Microbiologica Sinica, Mar. 4, 2021;61(3):621-30.

Yu et al., "Synthetic fusion protein design and applications". Biotechnology advances. Jan. 1, 2015;33(1):155-64.

* cited by examiner

Silver-stained SDS-PAGE
gel has no visible impurities in elution fraction (2)

1 2

250
150
100
75

Vp1 87kDa

Vp2 72kDa

Vp3 62kDa

50

37

1 = cellular supernatant
2 = purified AAV

B1 Western blot confirms presence of capsid proteins in
elution and depletion in capture supernatant VP1 87kDa VP2 72kDa VP3 62kDa CCH = cellular supernatant Capture Sup = supernatant after purification matrix applied Elution = purified AAV

Fig. 5A 250 150 100 75 50 37

Benzonase

Fig. 12

PURIFICATION MATRICES COMPRISING AAV-BINDING POLYPEPTIDES AND METHODS OF USING THE SAME

CROSS-REFERENCE TO RELATED APPLICATIONS

This application is the National Stage of International Application No. PCT/US2021/018812, filed on Feb. 19, 2021, which claims the benefit of U.S. Provisional Application No. 63/081,405, filed Sep. 22, 2020 and U.S. Provisional Application No. 62/978,616, filed Feb. 19, 2020. The contents of each of the aforementioned applications is incorporated by reference herein in its entirety.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: ISOL_003_02US_SubSeqList_ST25.txt, date recorded: Oct. 13, 2025; file size: 1,237,706 bytes).

FIELD

The present disclosure is generally related to compositions and methods for purification of biologics. More specifically, the disclosure is related to purification matrices comprising adeno-associated virus-binding polypeptides and methods of using the same.

BACKGROUND OF THE INVENTION

Adeno-associated virus (AAV) is a promising vehicle for delivery of one or more therapeutic genes in gene therapy. AAV is a small, replication-deficient DNA virus that is capable of integrating into the genome of an infected cell. AAV facilitates persistent expression of the therapeutic gene and reduces the need for repeated dosing of a gene therapy vector.

There are limitations to AAV production and purification methods, however, that make widespread use of AAVs for gene therapy difficult. AAV propagation requires the use of a helper virus, such as adenovirus. The requirement for helper virus complicates purification of AAV particles. Current approaches to AAV particle purification involve lysing of AAV-infected cells using repeated freeze-thaw cycles followed by the use of density gradient centrifugation to fractionate the cell lysate in order to obtain infectious AAV particles, free of cellular contaminants and substantially free of helper virus. Standard purification techniques generally result in very low yields (0.3-5%) of active (infectious) virus. Moreover, it is difficult to obtain AAV compositions that are totally free of the helper virus. Therefore, there exists a need in the art for improved AAV purification methods.

SUMMARY OF THE INVENTION

The present disclosure provides purification matrices comprising AAV-binding polypeptides and methods of using the same.

In some embodiments, the disclosure provides a purification matrix comprising an AAV-binding polypeptide coupled to a polypeptide having phase behavior, wherein the AAV-binding polypeptide comprises the ectodomain of the AAV receptor (AAVR), or an AAV-binding fragment or derivative thereof. In some embodiments, the AAV binding polypeptide is reversibly coupled to the polypeptide having phase behavior. In some embodiments, the AAV binding polypeptide is covalently coupled to the polypeptide having phase behavior.

In some embodiments, the AAVR is a human AAVR. In some embodiments, the AAVR is a monkey AAVR. In some embodiments, the AAVR is an orangutan AAVR. In some embodiments, the AAVR is a mouse AAVR. In some embodiments, the AAVR is a derivative of any one of the human, monkey, orangutan, or mouse AAVRs.

In some embodiments, the AAVR is a wildtype AAVR. In some embodiments, the AAVR is a mutant AAVR.

In some embodiments, the AAV-binding polypeptide comprises the sequence of any one of SEQ ID NOs: 29, 33, 52, or 64. In some embodiments, the AAV-binding polypeptide comprises the sequence of any one of SEQ ID NOs: 29, 33, 52, or 64 with up to 25 amino acid mutations.

In some embodiments, the AAV-binding polypeptide comprises amino acids 411 to 499 of SEQ ID NO: 35 with at least one, at least two, at least three, at least four, or at least five mutations. In some embodiments, each mutation is individually selected from the group consisting of V440H, S431H, Q432H, T434H, Y442H, I462H, D435H, D436H, K438H, and I439H.

In some embodiments, the AAV-binding polypeptide comprises any one of SEQ ID NOs: 28-32, 37-41, 43-47, and 52-86. In some embodiments, the AAV-binding polypeptide comprises at least two, at least three, at least four, or at least five of SEQ ID NOs: 28-32, 37-41, 43-47, and 52-86.

In some embodiments, the AAV-binding polypeptide comprises a polycystic kidney disease 1 (PKD1) domain, or a fragment thereof. In some embodiments, the AAV-binding polypeptide comprises a polycystic kidney disease 2 (PKD2) domain, or a fragment thereof. In some embodiments, the AAV-binding polypeptide comprises a polycystic kidney disease 3 (PKD3) domain, or a fragment thereof. In some embodiments, the AAV-binding polypeptide comprises a polycystic kidney disease 4 (PKD4) domain, or a fragment thereof. In some embodiments, the AAV-binding polypeptide comprises a polycystic kidney disease 5 (PKD5) domain, or a fragment thereof.

In some embodiments, the AAV-binding polypeptide comprises a sequence of SEQ ID NO: 29. In some embodiments, the AAV-binding polypeptide comprises a sequence of SEQ ID NO: 29, wherein at least one amino acid (i.e., a non-histidine amino acid) is mutated to histidine.

In some embodiments, the disclosure provides a purification matrix comprising an AAV-binding polypeptide coupled to a support, wherein the AAV-binding polypeptide comprises the ectodomain of the AAV receptor (AAVR), or an AAV-binding fragment or derivative thereof. In some embodiments, the support comprises a bead, a resin, a membrane, a fiber, a polymer, a plate, or a chip. In some embodiments, the support is a bead comprising sepharose, agarose, cellulose, polystyrene, polymethacrylate, and/or polyacrylamide. In some embodiments, the support is a magnetic bead. In some embodiments, the support is a polymer. In some embodiments, the support is a synthetic polymer.

In some embodiments, the AAV binding polypeptide is reversibly coupled to the support. In some embodiments, the AAV binding polypeptide is reversibly coupled to the polypeptide having phase behavior. In some embodiments, the AAV binding polypeptide is covalently coupled to the support. In some embodiments, the AAV binding polypeptide is covalently coupled to the polypeptide with phase behavior. In some embodiments, the AAV binding polypeptide is non-covalently coupled to the support. In some embodiments, the AAV binding polypeptide is non-covalently coupled to the polypeptide with phase behavior.

In some embodiments, the AAV binding polypeptide is coupled to the support via a linker. In some embodiments, the AAV binding polypeptide is coupled to the polypeptide with phase behavior via a linker. In some embodiments, the linker is a peptide linker. In some embodiments, the peptide linker comprises a protease cleavage site. In some embodiments, the linker is a chemical linker.

In some embodiments, a fusion protein comprises the AAV binding polypeptide and the polypeptide having phase behavior.

In some embodiments, the polypeptide having phase behavior is an elastin-like polypeptide. In some embodiments, the polypeptide having phase behavior is a resilin-like polypeptide.

In some embodiments, the polypeptide with phase behavior comprises a pentapeptide repeat having the sequence (Val-Pro-Gly-Xaa-Gly)$_n$ (SEQ ID NO: 10), or a randomized, scrambled analog thereof; wherein Xaa can be any amino acid except proline. In some embodiments, the polypeptide with phase behavior comprises a pentapeptide repeat having the sequence (Val-Pro-Gly-Xaa-Gly)$_n$ (SEQ ID NO: 10), or a randomized, scrambled analog thereof; wherein Xaa can be any amino acid except proline, wherein n is an integer between 1 and 360, inclusive of endpoints. In some embodiments, the polypeptide with phase behavior comprises an amino acid sequence selected from: (GRGDSPY)$_n$ (SEQ ID NO: 1); (GRGDSPH)$_n$ (SEQ ID NO: 2); (GRGDSPV)$_n$ (SEQ ID NO: 3); (GRGDSPYG)$_n$(SEQ ID NO: 4); (RPLGYDS)$_n$ (SEQ ID NO: 5); (RPAGYDS)$_n$(SEQ ID NO: 6); (GRGDSYP)$_n$ (SEQ ID NO: 7); (GRGDSPYQ)$_n$ (SEQ ID NO: 8); (GRGNSPYG)$_n$ (SEQ ID NO: 9); (GVGVP)$_n$ (SEQ ID NO: 11); (GVGVPGLGVPGVGV PGLGV PGVGVP)$_m$ (SEQ ID NO: 12); (GVGVPGVGVPGAGVP GV GVPGVGVP)$_n$ (SEQ ID NO: 13); (GVGVPGWGV PGVGVPGWGVPGVGVP)$_m$ (SEQ ID NO: 14); (GVG VPGVGVPGVGVPGVGVPGVGVPGVGVPGEGVPGF-GVPGVGVP)$_m$ (SEQ ID NO: 15); (GVGVPGVGVPGVG VPGVGVPGVGVPGVGVPGKGVPGFGVPGVGVP)$_m$ (SEQ ID NO: 16); and (GAGVPGVGVPGAGVPGVGVP-GAGVP)$_m$ (SEQ ID NO: 17); or a randomized, scrambled analog thereof; wherein: n is an integer in the range of 20-360; and m is an integer in the range of 4-25. In some embodiments, the polypeptide with phase behavior comprises an amino acid sequence of (GVGVPGVGVP-GAGVPGVGVPGVGVP)$_m$ (SEQ ID NO: 144) or (GVGVPGVGVPGLGVPGVGVPGVGVP)$_m$ (SEQ ID NO: 146), wherein m is an integer between 2 and 32, inclusive of endpoints. In some embodiments, the polypeptide with phase behavior comprises an amino acid sequence of (GVGVPGAGVP)$_m$ (SEQ ID NO: 145), wherein m is an integer between 5 and 80, inclusive of endpoints. In some embodiments, the polypeptide with phase behavior comprises an amino acid sequence of (GXGVP)$_m$ (SEQ ID NO: 147), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine. In some embodiments, the polypeptide with phase behavior comprises an amino acid sequence selected from (GVGVP)$_m$ (SEQ ID NO: 143), (ZZPXXXXGZ)$_m$ (SEQ ID NO: 148), (ZZPXGZ)$_m$ (SEQ ID NO: 149), (ZZPXXGZ)$_m$ (SEQ ID NO: 150), or (ZZPXXXGZ)$_m$ (SEQ ID NO: 151), wherein m is an integer between 10 and 160, inclusive of endpoints, wherein X if present is any amino acid except proline or glycine, and wherein Z if present is any amino acid. In some embodiments, the polypeptide with phase behavior comprises an amino acid sequence of (GRGDXPZX)$_m$ (SEQ ID NO: 152) or (XZPXDGRG)$_m$ (SEQ ID NO: 153), wherein X is glutamine or serine, Z is tyrosine or valine, and m is an integer between 10 and 160, inclusive of endpoints.

In some embodiments, the purification matrix comprises an AAV binding polypeptide having an amino acid sequence of SEQ ID NO: 29, SEQ ID NO: 52, or SEQ ID NO: 64 and a polypeptide with phase behavior comprising an amino acid sequence of (GVGVPGLGVPGVGVPGLGVPGVGVP)$_m$ (SEQ ID NO: 12), wherein m is 16. In some embodiments, the purification matrix comprises an amino acid sequence of SEQ ID NO: 87.

In some embodiments, the disclosure provides a method for purifying an AAV, the method comprising contacting the AAV with a purification matrix described herein.

In some embodiments, the AAV comprises a wildtype AAV capsid protein. In some embodiments, the AAV comprises a mutant AAV capsid protein. In some embodiments, the AAV comprises a capsid protein of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV.

In some embodiments, the AAV reversibly binds to the purification matrix to form an AAV-purification matrix complex. In some embodiments, the method comprises separating the AAV-purification matrix complex from one or more impurities. In some embodiments, the AAV-purification matrix complex is separated from the one or more impurities by washing the AAV-purification matrix complex.

In some embodiments, the method comprises eluting the AAV from the AAV-purification matrix complex. In some embodiments, the method comprises eluting the AAV by changing the pH of a composition comprising the AAV-purification matrix complex. In some embodiments, the method comprises eluting the AAV by changing the temperature of a composition comprising the AAV-purification matrix complex. In some embodiments, the method comprises eluting the AAV by changing the ionic strength of a composition comprising the AAV-purification matrix complex. In some embodiments, the method comprises eluting the AAV by the addition of a reducing agent to a composition comprising the AAV-purification matrix complex.

In some embodiments, the method comprises using a first environmental factor to increase the size of the AAV-purification matrix complex. In some embodiments, the first environmental factor comprises one or more of: a.) a change in one or more of temperature, pH, salt concentration or pressure; b.) the addition of one or more surfactants, cofactors, vitamins, molecular crowding agents, enzymes, denaturing agents; or c.) the application of electromagnetic or acoustic waves.

In some embodiments, the method comprises separating the AAV-purification matrix complex from at least one impurity on the basis of size. In some embodiments, the AAV-purification matrix complex is separated from at least one impurity on the basis of diameter. In some embodiments, the AAV-purification matrix complex is separated from at least one impurity on the basis of mass. In some embodiments, the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

In some embodiments, a second environmental factor is used to elute the AAV from the AAV-purification matrix complex. In some embodiments, the second environmental factor comprises one or more of: a change in one or more of temperature, pH, salt concentration or pressure; the addition of one or more surfactants, cofactors, vitamins, molecular crowding agents, denaturing agents, enzymes; or the application of electromagnetic or acoustic waves. In some embodiments, the methods of the disclosure are completed in about 2 hours to about 10 hours.

In some embodiments, the purification methods described herein are completed in about 4 hours to about 8 hours.

In some embodiments, a composition comprises an AAV particle purified according to a method of the disclosure. In some embodiments, the composition is at least 70%, at least 80%, at least 85%, at least 90%, at least 95%, at least 96%, at least 97%, at least 98%, or at least 99% free of impurities.

In some embodiments, an AAV binding polypeptide comprises the sequence of any one of SEQ ID NOs: 28-47, 52, or 64, or a sequence of any one of SEQ ID NOs: 28-47, 52 or 64 with at least one amino acid mutation.

Also provided herein are nucleic acids encoding one or more AAV binding polypeptides described herein.

Also provided herein are vectors comprising a nucleic acid encoding one or more AAV binding polypeptides described herein.

Also provided herein are compositions comprising an AAV binding polypeptide, nucleic acid encoding an AAV binding polypeptide, and/or a vector comprising a nucleic acid encoding an AAV binding polypeptide disclosed herein.

Also provided herein are kits comprising an AAV binding polypeptide, nucleic acid encoding an AAV binding polypeptide, and/or a vector comprising a nucleic acid encoding an AAV binding polypeptide disclosed herein.

Also provided herein is a method of increasing yield of AAV particles during production thereof, the method comprising culturing AAV-producing cells in the presence of a purification matrix. In some embodiments, at least about 10 μM of purification matrix is present. In some embodiments, at least about 10 μM of purification matrix is present. In some embodiments, the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV. In some embodiments, the AAV particles are mutant AAV particles. In some embodiments, the AAV particles reversibly bind to the purification matrix to form an AAV-purification matrix complex.

Also provided herein is a method of stabilizing AAV particles during production thereof, the method comprising culturing AAV-producing cells in the presence of a purification matrix. In some embodiments, at least about 10 μM of purification matrix is present. In some embodiments, at least about 10 μM of purification matrix is present. In some embodiments, the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV. In some embodiments, the AAV particles are mutant AAV particles. In some embodiments, the AAV particles reversibly bind to the purification matrix to form an AAV-purification matrix complex.

Also provided herein is a method of stabilizing AAV particles during purification thereof, the method comprising contacting the AAV particles with a purification matrix during purification thereof. In some embodiments, at least about 10 μM of purification matrix is present during purification of the AAV particles. In some embodiments, at least about 50 μM of purification matrix is present during purification of the AAV particles. In some embodiments, the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV. In some embodiments, the AAV particles are mutant AAV particles. In some embodiments, the AAV particles reversibly bind to the purification matrix to form an AAV-purification matrix complex.

Also provided herein is a method of stabilizing AAV particles during storage thereof, the method comprising storing the AAV particles in the presence of a purification matrix. In some embodiments, at least about 10 μM of purification matrix is present during purification of the AAV particles. In some embodiments, at least about 50 μM of purification matrix is present during purification of the AAV particles. In some embodiments, the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV. In some embodiments, the AAV particles are mutant AAV particles. In some embodiments, the AAV particles reversibly bind to the purification matrix to form an AAV-purification matrix complex.

Also provided herein is a method of increasing the shelf-life of AAV particles, the method comprising storing the AAV particles in the presence of a purification matrix. In some embodiments, at least about 10 μM of purification matrix is present during purification of the AAV particles. In some embodiments, at least about 50 μM of purification matrix is present during purification of the AAV particles. In some embodiments, the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV. In some embodiments, the AAV particles are mutant AAV particles. In some embodiments, the AAV particles reversibly bind to the purification matrix to form an AAV-purification matrix complex.

These and other embodiments will be further described below in the Detailed Description, Examples, and Claims.

BRIEF DESCRIPTION OF THE DRAWINGS

FIG. 5A shows pictures of cells infected with a control AAV particle (Pos Ctrl), or an AAV8 particle carrying a tdTomato transgene that was either (i) not purified by the methods of the disclosure (Pos Ctrl) or (ii) purified with a purification matrix of the disclosure (e.g. ViraTag™). Both control AAV and AAV purified with ViraTag™ are infectious. The image labeled "Neg Ctrl" shows cells which were not infected with any AAV particles.

FIG. 12 is a graph that shows dsDNA concentration in AAV8 samples with (+) or without (–) benzonase nuclease pre-treatment. With or without pre-treatment, the compositions comprising purified AAV8 eluted from the purification matrix had similar levels of dsDNA, as assessed by Quant-iT picogreen assay. Lysed SM: starting material comprised of clarified cell lysate; capture: purification matrix capture step supernatant; Elution: purification matrix elution step supernatant.

DETAILED DESCRIPTION OF THE INVENTION

Definitions

Figure 1:
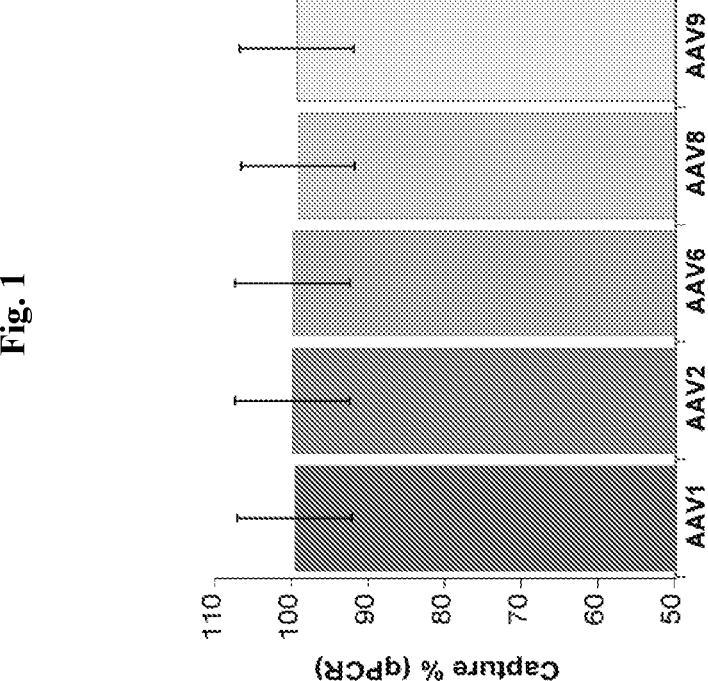
FIG. 1 shows the percentage of AAV particles captured from cellular supernatant using a purification matrix, as determined by quantitative polymerase chain reaction (qPCR).

As used herein, and in the appended claims, the singular forms "a", "an", and "the" include plural referents unless the context clearly dictates otherwise. Thus, for example, reference to "a protein" can refer to one protein or to mixtures of such protein, and reference to "the method" includes reference to equivalent steps and/or methods known to those skilled in the art, and so forth.

As used herein, the term "about" or "approximately" when preceding a numerical value indicates the value plus or minus a range of 10%. For example, "about 100" encompasses 90 and 110.

Also as used herein, "and/or" refers to and encompasses any and all possible combinations of one or more of the associated listed items, as well as the lack of combinations when interpreted in the alternative ("or").

Unless the context indicates otherwise, it is specifically intended that the various features described herein can be used in any combination.

Moreover, the present disclosure also contemplates that in some embodiments, any feature or combination of features set forth herein can be excluded or omitted. To illustrate further, if, for example, the specification indicates that a particular amino acid can be selected from A, G, I, L and/or V, this language also indicates that the amino acid can be selected from any subset of these amino acid(s) for example A, G, I or L; A, G, I or V; A or G; only L; etc., as if each such subcombination is expressly set forth herein. Moreover, such language also indicates that one or more of the specified amino acids can be disclaimed. For example, in particular embodiments the amino acid is not A, G or I; is not A; is not G or V; etc., as if each such possible disclaimer is expressly set forth herein.

An "adeno-associated virus" (AAV) is a small, replication-deficient parvovirus. As used herein, AAV may refer to a wildtype or mutant AAV of any one of the following serotypes: AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, and any other AAV now known or later discovered. In some embodiments, an AAV may have a single-stranded genome, or a double-stranded genome (e.g., a self-complementary AAV).

An "AAV particle" typically comprises a capsid, and a nucleic acid (e.g., a nucleic acid comprising a transgene) encapsidated by the protein capsid. The "capsid" is a near-spherical protein shell that comprises individual "capsid protein subunits" or "capsid proteins" (e.g., about 60 capsid protein subunits) associated and arranged with T=1 icosahedral symmetry. Accordingly, the capsids of the AAV vectors described herein comprise a plurality of capsid proteins. When an AAV particle is described as comprising a capsid protein, it will be understood that the AAV particle comprises a capsid, wherein the capsid comprises one or more AAV capsid proteins. When an AAV particle is described as binding to a binding domain, it will be understood that the binding domain may bind to one or more capsid proteins within the capsid. The term "empty AAV particle" or "empty capsid" refers to an AAV particle or capsid that does not comprise any vector genome or nucleic acid comprising an expression cassette or transgene.

As used herein, the term "AAV sample" used interchangeably herein with "AAV composition" refers to a composition that contains AAV particles. In some embodiments, the "AAV sample" refers to a composition containing AAV of a particular serotype. For example, an "AAV8 sample" refers to a composition comprising AAV8 particles.

As used herein, the term "contaminant" and "impurity" are used interchangeably. A contaminant may refer to any substance that is not desired in a purified composition. In some embodiments, the contaminant is any substance other than the biologic desired to be purified. Non-limiting examples of contaminants include, but are not limited to, a solvent, a protein, a peptide, a carbohydrate, a nucleic acid, a virus, a cell (e.g., a bacterial, yeast, or mammalian cell), a carbohydrate, a lipid, or a lipopolysaccharide. In some embodiments, the contaminant is an endotoxin or a mycotoxin.

As used herein, the term "fragment" as it refers to a protein or polypeptide includes a truncated form of the protein or polypeptide. For example, a fragment of AAVR may include about 1%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 97%, or about 99% of the amino acids of full-length AAVR.

As used herein, the terms "peptide," "polypeptide," and "protein" are used interchangeably, and refer to a compound comprised of amino acid residues covalently linked by peptide bonds. A protein must contain at least two amino acids, and no limitation is placed on the maximum number of amino acids that can comprise a protein's sequence. The term "peptide" may refer to a short chain of amino acids including, for example, natural peptides, recombinant peptides, synthetic peptides, or a combination thereof. Proteins and peptides may include, for example, biologically active fragments, substantially homologous polypeptides, oligopeptides, homodimers, heterodimers, variants of polypeptides, modified polypeptides, derivatives, analogs, and fusion proteins, among others.

A "polynucleotide" is a sequence of nucleotide bases, and may be RNA, DNA or DNA-RNA hybrid sequences (including both naturally occurring and non-naturally occurring nucleotides). In some embodiments, a polynucleotide is either a single or double stranded DNA sequence.

As used herein, by "isolate" or "purify" (or grammatical equivalents) a viral particle, it is meant that the viral particle is at least partially separated from at least some of the other components in a starting material comprising the viral particle (e.g., a cell lysate). In representative embodiments an "isolated" or "purified" viral particle is enriched by at least about 10-fold, about 100-fold, about 1000-fold, about 10,000-fold or more as compared with the starting material.

As used herein, the term "amino acid" encompasses any naturally occurring amino acid, modified forms thereof, and synthetic amino acids. Naturally occurring, levorotatory (L-) amino acids are shown in Table 1.

TABLE 1

| Amino acid residues and abbreviations. | | |
| --- | --- | --- |
| Amino Acid Residue | Abbreviation Three-Letter Code | One-Letter Code |
| Alanine | Ala | A |
| Arginine | Arg | R |
| Asparagine | Asn | N |
| Aspartic acid (Aspartate) | Asp | D |
| Cysteine | Cys | C |
| Glutamine | Gln | Q |
| Glutamic acid (Glutamate) | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |

TABLE 1-continued

| Amino acid residues and abbreviations. | | |
|---|---|---|
| Amino Acid Residue | Abbreviation Three-Letter Code | One-Letter Code |
| Serine | Ser | S |
| Threonine | Thr | T |
| Tryptophan | Trp | W |
| Tyrosine | Tyr | Y |
| Valine | Val | V |

Alternatively, the amino acid can be a modified amino acid residue (nonlimiting examples are shown in Table 2) and/or can be an amino acid that is modified by post-translational modification (e.g., acetylation, amidation, formylation, hydroxylation, methylation, phosphorylation or sulfatation).

TABLE 2

| Modified Amino Acid Residues. | |
|---|---|
| Modified Amino Acid Residue Amino Acid Residue Derivatives | Abbreviation |
| 2-Aminoadipic acid | Aad |
| 3-Aminoadipic acid | bAad |
| beta-Alanine, beta-Aminoproprionic acid | bAla |
| 2-Aminobutyric acid | Abu |
| 4-Aminobutyric acid, Piperidinic acid | 4Abu |
| 6-Aminocaproic acid | Acp |
| 2-Aminoheptanoic acid | Ahe |
| 2-Aminoisobutyric acid | Aib |
| 3-Aminoisobutyric acid | bAib |
| 2-Aminopimelic acid | Apm |
| t-butylalanine | t-BuA |
| Citrulline | Cit |
| Cyclohexylalanine | Cha |
| 2,4-Diaminobutyric acid | Dbu |
| Desmosine | Des |
| 2,21-Diaminopimelic acid | Dpm |
| 2,3-Diaminoproprionic acid | Dpr |
| N-Ethylglycine | EtGly |
| N-Ethylasparagine | EtAsn |
| Homoarginine | hArg |
| Homocysteine | hCys |
| Homoserine | hSer |
| Hydroxylysine | Hyl |
| Allo-Hydroxylysine | aHyl |
| 3-Hydroxyproline | 3Hyp |
| 4-Hydroxyproline | 4Hyp |
| Isodesmosine | Ide |
| allo-Isoleucine | aIle |
| Methionine sulfoxide | MSO |
| N-Methylglycine, sarcosine | MeGly |
| N-Methyl isoleucine | MeIle |
| 6-N-Methyllysine | MeLys |
| N-Methylvaline | MeVal |
| 2-Naphthylalanine | 2-Nal |
| Norvaline | Nva |
| Norleucine | Nle |
| Omithine | Orn |
| 4-Chlorophenylalanine | Phe(4-Cl) |
| 2-Fluorophenylalanine | Phe(2-F) |
| 3-Fluorophenylalanine | Phe(3-F) |
| 4-Fluorophenylalanine | Phe(4-F) |
| Phenylglycine | Phg |
| Beta-2-thienylalanine | Thi |

Further, the non-naturally occurring amino acid can be an "unnatural" amino acid.

As used herein, the term "environmental factor" is any factor that, when applied to a composition comprising a protein-based purification matrix, alters one or more properties of the composition. Non-limiting examples of environmental factors include a change in one or more of temperature, pH, salt concentration, concentration of the purification matrix, concentration of the biologic, or pressure, the addition of one or more surfactants, cofactors, vitamins, molecular crowding agents, denaturing agents, reducing agents, or oxidizing agents; or the application of electromagnetic or acoustic waves.

As used herein, the term "polypeptide with phase behavior" refers to any polypeptide that is capable of undergoing a phase transition. In some embodiments, the polypeptide undergoes a phase transition due to the application of an environmental factor. Exemplary polypeptides with phase behavior include elastin-like polypeptides (ELPs) and resilin-like polypeptides (RLPs). As used herein, the term "fusion protein" refers to a polypeptide produced when two heterologous nucleotide sequences or fragments thereof coding for two (or more) different polypeptides not found fused together in nature are fused together in the correct translational reading frame.

Purification Matrices Comprising AAV-Binding Polypeptide

The disclosure provides purification matrices comprising recombinant adeno-associated virus (AAV)-binding polypeptides. In some embodiments, the disclosure provides methods of purifying adeno-associated virus (AAV) particles comprising contacting the AAV particles with the purification matrices described herein. In some embodiments, the methods described herein yield high titers of AAV particles and remove one or more contaminants from compositions comprising AAV particles.

Adeno-Associated Viruses (AAV)

In some embodiments, the purification matrices described herein are utilized to purify AAV particles. AAVs belong to the Dependoparvovirus genus within the Parvoviridae family. AAV has a linear single-stranded DNA (ssDNA) genome of approximately 4.7 kilobases with two 145 nucleotide-long inverted terminal repeats (TTR) at the termini. AAVs do not encode a polymerase and rely on cellular polymerases for genome replication.

AAV can be propagated as a lytic virus or maintained as a provirus, integrated into host cell DNA. Although under certain conditions AAV can replicate in the absence of helper virus, efficient replication requires coinfection with a helper virus, such as adenovirus, cytomegalovirus, Epstein-Barr virus, or vaccinia virus.

The compositions and methods disclosed herein may be used to purify a wildtype or mutant AAV particle of any one of the following serotypes: AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, or any other AAV now known or later discovered.

AAV-Binding Polypeptides

In some embodiments, the disclosure provides a purification matrix comprising an AAV-binding polypeptide. In some embodiments, the AAV-binding polypeptide comprises the ectodomain of the AAV receptor (AAVR), or an AAV-binding fragment or derivative thereof.

The AAVR, also named KIAA0319L (see, e.g., Uniprot Accession No. Q81ZA0), is a 150 kDa glycoprotein which binds to the capsid of multiple AAV serotypes, including AAV1, AAV2, AAV3B, AAV5, AAV6, AAV8, and AAV9. The ectodomain of the AAVR comprises a motif at the N-terminus with eight cysteines (MANEC) and five immunoglobulin domains known as polycystic kidney disease (PKD) domains. AAV particles bind to the PKD domains to facilitate transduction. Thus, in some embodiments, the AAV-binding polypeptides described herein comprise one, two, three, four, or five PKD domains, or fragments or derivatives thereof.

In some embodiments, the AAV-binding polypeptide comprises the human AAVR (SEQ ID NO: 35), mouse AAVR (SEQ ID NO: 36), or orangutan AAVR (SEQ ID NO: 42), or a fragment or derivative thereof. In some embodiments, the AAV-binding polypeptide comprises a sequence with at least 90% or at least 95% identity to any one of SEQ ID NO: 35, 36, or 42. In some embodiments, the AAV-binding polypeptide comprises an ectodomain of AAVR or a fragment or derivative thereof. In some embodiments, the AAV-binding polypeptide comprises a fragment of the AAVR comprising an N-terminal methionine. In some embodiments, the AAV-binding polypeptide comprises the amino acid sequence of SEQ ID NO: 33. In some embodiments, the AAV-binding polypeptide comprises the amino acid sequence of SEQ ID NO: 34.

In some embodiments, the AAV-binding polypeptide comprises the sequence of SEQ ID NO: 33 or SEQ ID NO: 34 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the AAV binding polypeptide comprises the sequence of SEQ ID NO: 33 or SEQ ID NO: 34, or a sequence with at least about 70%, about 75%, about 80%, about 85%, about 90%, about 95%, about 96%, about 97%, about 98%, about 99% identity thereto. Unless otherwise indicated, sequence identity is determined using the National Center for Biotechnology Information (NCBI)'s Basic Local Alignment Search Tool (BLAST®), available at blast.ncbi.nlm.nih.gov/Blast.cgi. In some embodiments, the sequence identity is calculated over the entire length of the compared sequences. In some embodiments, the sequence identity is calculated over a 20-amino acid, 50-amino acid, 75-amino acid, 100-amino acid, 250-amino acid, 500-amino acid, 750-amino acid, or 1000-amino acid fragment of each compared sequence.

In some embodiments, the AAV-binding polypeptides described herein comprise one or more PKDs, such as two, three, four, five, or more PKDs. In some embodiments, the PKDs are each individually selected from the PKDs listed in Table 3. For example, in some embodiments, the PKDs are each individually selected from SEQ ID NO: 28-32, 37-41, and 43-47. In some embodiments, an AAV-binding polypeptide comprises multiple PKDs, and the PKDs are connected to one another by a linker. Non-limiting examples of linkers are described throughout this disclosure. In some embodiments, an AAV-binding polypeptide comprises multiple PKD domains, wherein each PKD domain has the same or substantially the same sequence. In some embodiments, an AAV-binding polypeptide comprises multiple PKD domains, wherein each PKD has a different sequence.

TABLE 3

Amino Acid Sequences of PKDs

| PKD | SEQ ID NO. |
|---|---|
| Human PKD1 | 28 |
| Human PKD2 | 29 |
| Human PKD3 | 30 |

TABLE 3-continued

Amino Acid Sequences of PKDs

| PKD | SEQ ID NO. |
|---|---|
| Human PKD4 | 31 |
| Human PKD5 | 32 |
| Mouse PKD1 | 37 |
| Mouse PKD2 | 38 |
| Mouse PKD3 | 39 |
| Mouse PKD4 | 40 |
| Mouse PKDS | 41 |
| Orangutan PKD1 | 43 |
| Orangutan PKD2 | 44 |
| Orangutan PKD3 | 45 |
| Orangutan PKD4 | 46 |
| Orangutan PKD5 | 47 |

In some embodiments, the AAV-binding polypeptides comprise a polycystic kidney disease 1 (PDK1) domain. In some embodiments, the AAV-binding polypeptides comprise a polycystic kidney disease 2 (PDK2) domain. In some embodiments, the AAV-binding polypeptides comprise a polycystic kidney disease 3 (PDK3) domain. In some embodiments, the AAV-binding polypeptides comprise a polycystic kidney disease 4 (PDK4) domain. In some embodiments, the AAV-binding polypeptides comprise a polycystic kidney disease 5 (PDK5) domain In some embodiments, the AAV-binding polypeptide comprises a PKD1 and a PKD2 domain. In some embodiments, the AAV-binding polypeptide comprises a PKD1 and a PKD2 domain having an amino acid sequence of SEQ ID NO: 92. In some embodiments, the AAV-binding polypeptide comprises a PKD1 and a PKD3 domain. In some embodiments, the AAV-binding polypeptide comprises a PKD1 and a PKD4 domain. In some embodiments, the AAV-binding polypeptide comprises a PKD1 and a PKD5 domain. In some embodiments, the AAV-binding polypeptide comprises a PKD2 and a PKD3 domain. In some embodiments, the AAV-binding polypeptide comprises a PKD2 and a PKD4 domain. In some embodiments, the AAV-binding polypeptide comprises a PKD2 and a PKD5 domain. In some embodiments, the AAV-binding polypeptide comprises a PKD3 and a PKD4 domain. In some embodiments, the AAV-binding polypeptide comprises a PKD3 and a PKD5 domain. In some embodiments, the AAV-binding polypeptide comprises a PKD4 and a PKD5 domain. In some embodiments, the AAV-binding polypeptide comprises three PKD domains, wherein each PKD domain is independently selected from any one of PKD1-5. In some embodiments, the AAV-binding polypeptide comprises four PKD domains, wherein each PKD domain is independently selected from any one of PKD1-5. In some embodiments, the AAV-binding polypeptide comprises five PKD domains, wherein each PKD domain is independently selected from any one of PKD1-5. In some embodiments, the AAV-binding polypeptide comprises more than five PKD domains, wherein each PKD domain is independently selected from any one of PKD1-5.

In any of the embodiments of the preceding paragraph, each of the PKD domains may be independently selected from a wildtype or a mutant PKD domain. In some embodiments, each PKD may have at least 70%, at least 80%, at least 85%, at least 90%, at least 95%, at least 96%, at least 97%, at least 98%, at least 99%/o, or at least 100% sequence identity to a wild type PKD. In some embodiments, the AAV-binding polypeptides disclosed herein comprise an amino acid sequence with at least about 70%, at least about 75%, at least about 80%, at least about 85%, at least about 90%/o, or at least about 95% sequence identity to a wild type PKD. In some embodiment, the AAV-binding polypeptides bind to AAV using one or more PKDs.

In some embodiments, the AAV-binding polypeptides described herein comprise at least about 1, at least about 2, at least about 3, at least about 4, at least about 5, at least about 6, at least about 7, at least about 8, at least about 9, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25 amino acid mutations relative to a wild-type AAVR or PKD thereof. In some embodiments, the AAV-binding polypeptides comprise up to about 25 amino acid mutations, or more, relative to a wildtype AAVR or PKD thereof. For example, the AAV binding polypeptides may comprise about 25-35, about 35-45, about 45-55, about 55-65, or about 65-75 amino acid mutations relative to a wildtype AAVR.

In some embodiments, the AAV-binding polypeptides described herein comprise at least about 1, at least about 2, at least about 3, at least about 4, at least about 5, at least about 6, at least about 7, at least about 8, at least about 9, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25 amino acid mutations relative to a wild type AAVR or PKD thereof, wherein each mutation comprises a change of a native amino acid residue to a histidine.

In some embodiments, the AAV-binding polypeptide comprises a sequence of SEQ ID NO: 29. In some embodiments, the AAV-binding polypeptide comprises a sequence of SEQ ID NO: 29, wherein at least one amino acid (i.e., a non-histidine amino acid) is mutated to histidine.

In some embodiments, the AAV-binding polypeptide comprises SEQ ID NO; 35 with at least one, at least two, at least three, at least four, or at least five mutations. In some embodiments, each mutation is individually selected from the group consisting of V440H, S431H, Q432H, T434H, Y442H, I462H, D435H, D436H, K438H, and 1439H.

In some embodiments, the AAV-binding polypeptide comprises amino acids 411 to 499 of SEQ ID) NO: 35 with at least one, at least two, at least three, at least four, or at least five mutations, wherein each mutation is individually selected from the group consisting of V440H, 431H, Q432H, T434H, Y442H, I462H, D435H, D436H, K438H and I439H.

In some embodiments, the AAV-binding polypeptides of SEQ ID NO: 35 or fragments thereof have one or more of the combinations of mutations in Table 4. Each row in Table 4 signifies a combination of mutations.

TABLE 4

| Combinations of Mutations | | | | |
| --- | --- | --- | --- | --- |
| Mutation 1 | Mutation 2 | Mutation 3 | Mutation 4 | Mutation 5 |
| S431H | V440H | | | |
| Q432H | V440H | | | |
| Q432H | S431H | | | |
| T434H | V440H | | | |
| T434H | S431H | | | |
| T434H | Q432H | | | |
| Y442H | V440H | | | |

TABLE 4-continued

| Combinations of Mutations | | | | |
| --- | --- | --- | --- | --- |
| Mutation 1 | Mutation 2 | Mutation 3 | Mutation 4 | Mutation 5 |
| Y442H | S431H | | | |
| Y442H | Q432H | | | |
| Y442H | T434H | | | |
| I462H | V440H | | | |
| I462H | S431H | | | |
| I462H | Q432H | | | |
| I462H | T434H | | | |
| I462H | Y442H | | | |
| D43SH | V440H | | | |
| D435H | S431H | | | |
| D435H | Q432H | | | |
| D435H | T434H | | | |
| D435H | Y442H | | | |
| D436H | V440H | | | |
| D436H | S431H | | | |
| D436H | Q432H | | | |
| D436H | T434H | | | |
| D436H | Y442H | | | |
| D435H | I462H | | | |
| D436H | I462H | | | |
| D436H | D435H | | | |
| I439H | V440H | | | |
| I439H | S431H | | | |
| I439H | Q432H | | | |
| I439H | T434H | | | |
| I439H | Y442H | | | |
| K438H | V440H | | | |
| K438H | S431H | | | |
| K438H | Q432H | | | |
| K438H | T434H | | | |
| I439H | I462H | | | |
| K438H | Y442H | | | |
| I439H | D435H | | | |
| I439H | D436H | | | |
| K438H | I462H | | | |
| K438H | D435H | | | |
| K438H | D436H | | | |
| I439H | K438H | | | |
| S431H | V440H | Q432H | | |
| S431H | V440H | T434H | | |
| Q432H | V440H | T434H | | |
| Q432H | S431H | T434H | | |
| S431H | V440H | Y442H | | |
| Q432H | V440H | Y442H | | |
| Q432H | S431H | Y442H | | |
| T434H | V440H | Y442H | | |
| T434H | S431H | Y442H | | |
| T434H | Q432H | Y442H | | |
| S431H | V440H | I462H | | |
| Q432H | V440H | I462H | | |
| Q432H | S431H | I462H | | |
| T434H | V440H | I462H | | |
| T434H | S431H | I462H | | |
| T434H | Q432H | I462H | | |
| Y442H | V440H | I462H | | |
| Y442H | S431H | I462H | | |
| Y442H | Q432H | I462H | | |
| Y442H | T434H | I462H | | |
| S431H | V440H | D435H | | |
| Q432H | V440H | D435H | | |
| Q432H | S431H | D435H | | |
| T434H | V440H | D435H | | |
| T434H | S431H | D435H | | |
| T434H | Q432H | D435H | | |
| Y442H | V440H | D435H | | |
| Y442H | S431H | D435H | | |
| Y442H | Q432H | D435H | | |
| Y442H | T434H | D435H | | |
| S431H | V440H | D436H | | |
| Q432H | V440H | D436H | | |
| Q432H | S431H | D436H | | |
| T434H | V440H | D436H | | |
| T434H | S431H | D436H | | |
| T434H | Q432H | D436H | | |
| Y442H | V440H | D436H | | |
| Y442H | S431H | D436H | | |

TABLE 4-continued

| | Combinations of Mutations | | | |
|---|---|---|---|---|
| Mutation 1 | Mutation 2 | Mutation 3 | Mutation 4 | Mutation 5 |
| Y442H | Q432H | D436H | | |
| Y442H | T434H | D436H | | |
| I462H | V440H | D435H | | |
| I462H | S431H | D435H | | |
| I462H | Q432H | D435H | | |
| I462H | T434H | D435H | | |
| I462H | Y442H | D435H | | |
| I462H | V440H | D436H | | |
| I462H | S431H | D436H | | |
| I462H | Q432H | D436H | | |
| I462H | T434H | D436H | | |
| I462H | Y442H | D436H | | |
| D435H | V440H | D436H | | |
| D435H | S431H | D436H | | |
| D435H | Q432H | D436H | | |
| D435H | T434H | D436H | | |
| D435H | Y442H | D436H | | |
| D435H | I462H | D436H | | |
| S431H | V440H | I439H | | |
| Q432H | V440H | I439H | | |
| Q432H | S431H | I439H | | |
| T434H | V440H | I439H | | |
| T434H | S431H | I439H | | |
| T434H | Q432H | I439H | | |
| Y442H | V440H | I439H | | |
| Y442H | S431H | I439H | | |
| Y442H | Q432H | I439H | | |
| Y442H | T434H | I439H | | |
| S431H | V440H | K438H | | |
| Q432H | V440H | K438H | | |
| Q432H | S431H | K438H | | |
| T434H | V440H | K438H | | |
| T434H | S431H | K438H | | |
| T434H | Q432H | K438H | | |
| I462H | V440H | I439H | | |
| I462H | S431H | I439H | | |
| Y442H | V440H | K438H | | |
| I462H | Q432H | I439H | | |
| Y442H | S431H | K438H | | |
| I462H | T434H | I439H | | |
| Y442H | Q432H | K438H | | |
| Y442H | T434H | K438H | | |
| I462H | Y442H | I439H | | |
| D43SH | V440H | I439H | | |
| D435H | S431H | I439H | | |
| D435H | Q432H | I439H | | |
| D435H | T434H | I439H | | |
| D435H | Y442H | I439H | | |
| D436H | V440H | I439H | | |
| D436H | S431H | I439H | | |
| D436H | Q432H | I439H | | |
| D436H | T434H | I439H | | |
| I462H | V440H | K438H | | |
| I462H | S431H | K438H | | |
| I462H | Q432H | K438H | | |
| I462H | T434H | K438H | | |
| D436H | Y442H | I439H | | |
| I462H | Y442H | K438H | | |
| D435H | V440H | K438H | | |
| D435H | S431H | K438H | | |
| D435H | Q432H | K438H | | |
| D435H | T434H | K438H | | |
| D435H | I462H | I439H | | |
| D435H | Y442H | K438H | | |
| D436H | V440H | K438H | | |
| D436H | S431H | K438H | | |
| D436H | Q432H | K438H | | |
| D436H | T434H | K438H | | |
| D436H | I462H | I439H | | |
| D436H | Y442H | K438H | | |
| D436H | D435H | I439H | | |
| D435H | I462H | K438H | | |
| D436H | I462H | K438H | | |
| D436H | D435H | K438H | | |
| I439H | V440H | K438H | | |
| I439H | S431H | K438H | | |
| I439H | Q432H | K438H | | |
| I439H | T434H | K438H | | |
| I439H | Y442H | K438H | | |
| I462H | I462H | K438H | | |
| I439H | D435H | K438H | | |
| I439H | D436H | K438H | | |
| S431H | V440H | Q432H | T434H | |
| S431H | V440H | Q432H | Y442H | |
| S431H | V440H | T434H | Y442H | |
| Q432H | V440H | T434H | Y442H | |
| Q432H | S431H | T434H | Y442H | |
| S431H | V440H | Q432H | I462H | |
| S431H | V440H | T434H | I462H | |
| Q432H | V440H | T434H | I462H | |
| Q432H | S431H | T434H | I462H | |
| S431H | V440H | Y442H | I462H | |
| Q432H | V440H | Y442H | I462H | |
| Q432H | S431H | Y442H | I462H | |
| T434H | V440H | Y442H | I462H | |
| T434H | S431H | Y442H | I462H | |
| T434H | Q432H | Y442H | I462H | |
| S431H | V440H | Q432H | D435H | |
| S431H | V440H | T434H | D435H | |
| Q432H | V440H | T434H | D43SH | |
| Q432H | S431H | T434H | D435H | |
| S431H | V440H | Y442H | D435H | |
| Q432H | V440H | Y442H | D435H | |
| Q432H | S431H | Y442H | D435H | |
| T434H | V440H | Y442H | D435H | |
| T434H | S431H | Y442H | D435H | |
| T434H | Q432H | Y442H | D435H | |
| S431H | V440H | Q432H | D436H | |
| S431H | V440H | T434H | D436H | |
| Q432H | V440H | T434H | D436H | |
| Q432H | S431H | T434H | D436H | |
| S431H | V440H | Y442H | D436H | |
| Q432H | V440H | Y442H | D436H | |
| Q432H | S431H | Y442H | D436H | |
| T434H | V440H | Y442H | D436H | |
| T434H | S431H | Y442H | D436H | |
| T434H | Q432H | Y442H | D436H | |
| S431H | V440H | I462H | D435H | |
| Q432H | V440H | I462H | D435H | |
| Q432H | S431H | I462H | D43SH | |
| T434H | V440H | I462H | D435H | |
| T434H | S431H | I462H | D435H | |
| T434H | Q432H | I462H | D43SH | |
| Y442H | V440H | I462H | D435H | |
| Y442H | S431H | I462H | D435H | |
| Y442H | Q432H | I462H | D435H | |
| Y442H | T434H | I462H | D435H | |
| S431H | V440H | I462H | D436H | |
| Q432H | V440H | I462H | D436H | |
| Q432H | S431H | I462H | D436H | |
| T434H | V440H | I462H | D436H | |
| T434H | S431H | I462H | D436H | |
| T434H | Q432H | I462H | D436H | |
| Y442H | V440H | I462H | D436H | |
| Y442H | S431H | I462H | D436H | |
| Y442H | Q432H | I462H | D436H | |
| Y442H | T434H | I462H | D436H | |
| S431H | V440H | D435H | D436H | |
| Q432H | V440H | D435H | D436H | |
| Q432H | S431H | D435H | D436H | |
| T434H | V440H | D435H | D436H | |
| T434H | S431H | D435H | D436H | |
| T434H | Q432H | D435H | D436H | |
| Y442H | V440H | D435H | D436H | |
| Y442H | S431H | D435H | D436H | |
| Y442H | Q432H | D435H | D436H | |
| Y442H | T434H | D435H | D436H | |
| I462H | V440H | D435H | D436H | |
| I462H | S431H | D435H | D436H | |
| I462H | Q432H | D435H | D436H | |
| I462H | T434H | D435H | D436H | |
| I462H | Y442H | D435H | D436H | |

| Mutation 1 | Mutation 2 | Mutation 3 | Mutation 4 | Mutation 5 |
|---|---|---|---|---|
| S431H | V440H | Q432H | I439H | |
| S431H | V440H | T434H | I439H | |
| Q432H | V440H | T434H | I439H | |
| Q432H | S431H | T434H | I439H | |
| S431H | V440H | Y442H | I439H | |
| Q432H | V440H | Y442H | I439H | |
| Q432H | S431H | Y442H | I439H | |
| T434H | V440H | Y442H | I439H | |
| T434H | S431H | Y442H | I439H | |
| T434H | Q432H | Y442H | I439H | |
| S431H | V440H | Q432H | K438H | |
| S431H | V440H | T434H | K438H | |
| Q432H | V440H | T434H | K438H | |
| Q432H | S431H | T434H | K438H | |
| S431H | V440H | I462H | I439H | |
| Q432H | V440H | I462H | I439H | |
| S431H | V440H | Y442H | K438H | |
| Q432H | S431H | I462H | I439H | |
| T434H | V440H | I462H | I439H | |
| Q432H | V440H | Y442H | K438H | |
| T434H | S431H | I462H | I439H | |
| Q432H | S431H | Y442H | K438H | |
| T434H | V440H | Y442H | K438H | |
| T434H | Q432H | I462H | I439H | |
| T434H | S431H | Y442H | K438H | |
| T434H | Q432H | Y442H | K438H | |
| Y442H | V440H | I462H | I439H | |
| Y442H | S431H | I462H | I439H | |
| Y442H | Q432H | I462H | I439H | |
| Y442H | T434H | I462H | I439H | |
| S431H | V440H | D435H | I439H | |
| Q432H | V440H | D435H | I439H | |
| Q432H | S431H | D435H | I439H | |
| T434H | V440H | D435H | I439H | |
| T434H | S431H | D435H | I439H | |
| T434H | Q432H | D435H | I439H | |
| Y442H | V440H | D435H | I439H | |
| Y442H | S431H | D435H | I439H | |
| Y442H | Q432H | D435H | I439H | |
| Y442H | T434H | D435H | I439H | |
| S431H | V440H | D436H | I439H | |
| Q432H | V440H | D436H | I439H | |
| Q432H | S431H | D436H | I439H | |
| T434H | V440H | D436H | I439H | |
| T434H | S431H | D436H | I439H | |
| T434H | Q432H | D436H | I439H | |
| S431H | V440H | I462H | K438H | |
| Q432H | V440H | I462H | K438H | |
| Q432H | S431H | I462H | K438H | |
| T434H | V440H | I462H | K438H | |
| T434H | S431H | I462H | K438H | |
| T434H | Q432H | I462H | K438H | |
| Y442H | V440H | D436H | I439H | |
| Y442H | S431H | D436H | I439H | |
| Y442H | Q432H | D436H | I439H | |
| Y442H | T434H | D436H | I439H | |
| Y442H | V440H | I462H | K438H | |
| Y442H | S431H | I462H | K438H | |
| Y442H | Q432H | I462H | K438H | |
| Y442H | T434H | I462H | K438H | |
| S431H | V440H | D435H | K438H | |
| Q432H | V440H | D435H | K438H | |
| Q432H | S431H | D435H | K438H | |
| T434H | V440H | D435H | K438H | |
| T434H | S431H | D435H | K438H | |
| T434H | Q432H | D435H | K438H | |
| I462H | V440H | D435H | I439H | |
| I462H | S431H | D435H | I439H | |
| Y442H | V440H | D435H | K438H | |
| I462H | Q432H | D435H | I439H | |
| Y442H | S431H | D435H | K438H | |
| I462H | T434H | D435H | I439H | |
| Y442H | Q432H | D435H | K438H | |
| Y442H | T434H | D435H | K438H | |
| I462H | Y442H | D435H | I439H | |
| S431H | V440H | D436H | K438H | |
| Q432H | V440H | D436H | K438H | |
| Q432H | S431H | D436H | K438H | |
| T434H | V440H | D436H | K438H | |
| T434H | S431H | D436H | K438H | |
| T434H | Q432H | D436H | K438H | |
| I462H | V440H | D436H | I439H | |
| I462H | S431H | D436H | I439H | |
| Y442H | V440H | D436H | K438H | |
| I462H | Q432H | D436H | I439H | |
| Y442H | S431H | D436H | K438H | |
| I462H | T434H | D436H | I439H | |
| Y442H | Q432H | D436H | K438H | |
| Y442H | T434H | D436H | K438H | |
| I462H | Y442H | D436H | I439H | |
| D435H | V440H | D436H | I439H | |
| D435H | S431H | D436H | I439H | |
| D435H | Q432H | D436H | I439H | |
| D435H | T434H | D436H | I439H | |
| I462H | V440H | D435H | K438H | |
| I462H | S431H | D435H | K438H | |
| I462H | Q432H | D435H | K438H | |
| I462H | T434H | D435H | K438H | |
| D43SH | Y442H | D436H | I439H | |
| I462H | Y442H | D435H | K438H | |
| I462H | V440H | D436H | K438H | |
| I462H | S431H | D436H | K438H | |
| I462H | Q432H | D436H | K438H | |
| I462H | T434H | D436H | K438H | |
| I462H | Y442H | D436H | K438H | |
| D43SH | V440H | D436H | K438H | |
| D435H | S431H | D436H | K438H | |
| D435H | Q432H | D436H | K438H | |
| D43SH | T434H | D436H | K438H | |
| D435H | I462H | D436H | I439H | |
| D435H | Y442H | D436H | K438H | |
| D435H | I462H | D436H | K438H | |
| S431H | V440H | I439H | K438H | |
| Q432H | V440H | I439H | K438H | |
| Q432H | S431H | I439H | K438H | |
| T434H | V440H | I439H | K438H | |
| T434H | S431H | I439H | K438H | |
| T434H | Q432H | I439H | K438H | |
| Y442H | V440H | I439H | K438H | |
| Y442H | S431H | I439H | K438H | |
| Y442H | Q432H | I439H | K438H | |
| Y442H | T434H | I439H | K438H | |
| I462H | V440H | I439H | K438H | |
| I462H | S431H | I439H | K438H | |
| I462H | Q432H | I439H | K438H | |
| I462H | T434H | I439H | K438H | |
| I462H | Y442H | I439H | K438H | |
| D435H | V440H | I439H | K438H | |
| D43SH | S431H | I439H | K438H | |
| D435H | Q432H | I439H | K438H | |
| D435H | T434H | I439H | K438H | |
| D43SH | Y442H | I439H | K438H | |
| D436H | V440H | I439H | K438H | |
| D436H | S431H | I439H | K438H | |
| D436H | Q432H | I439H | K438H | |
| D436H | T434H | I439H | K438H | |
| D436H | Y442H | I439H | K438H | |
| D435H | I462H | I439H | K438H | |
| D436H | I462H | I439H | K438H | |
| D436H | D43SH | I439H | K438H | |
| S431H | V440H | Q432H | T434H | Y442H |
| S431H | V440H | Q432H | T434H | I462H |
| S431H | V440H | Q432H | Y442H | I462H |
| S431H | V440H | T434H | Y442H | I462H |
| Q432H | V440H | T434H | Y442H | I462H |
| Q432H | S431H | T434H | Y442H | I462H |
| S431H | V440H | Q432H | T434H | D435H |
| S431H | V440H | Q432H | Y442H | D435H |
| S431H | V440H | T434H | Y442H | D435H |
| Q432H | V440H | T434H | Y442H | D435H |
| Q432H | S431H | T434H | Y442H | D435H |
| S431H | V440H | Q432H | T434H | D436H |

TABLE 4-continued

Combinations of Mutations

| Mutation 1 | Mutation 2 | Mutation 3 | Mutation 4 | Mutation 5 |
|---|---|---|---|---|
| S431H | V440H | Q432H | Y442H | D436H |
| S431H | V440H | T434H | Y442H | D436H |
| Q432H | V440H | T434H | Y442H | D436H |
| Q432H | S431H | T434H | Y442H | D436H |
| S431H | V440H | Q432H | I462H | D43SH |
| S431H | V440H | T434H | I462H | D435H |
| Q432H | V440H | T434H | I462H | D435H |
| Q432H | S431H | T434H | I462H | D435H |
| S431H | V440H | Y442H | I462H | D435H |
| Q432H | V440H | Y442H | I462H | D435H |
| Q432H | S431H | Y442H | I462H | D43SH |
| T434H | V440H | Y442H | I462H | D435H |
| T434H | S431H | Y442H | I462H | D435H |
| T434H | Q432H | Y442H | I462H | D43SH |
| S431H | V440H | Q432H | I462H | D436H |
| S431H | V440H | T434H | I462H | D436H |
| Q432H | V440H | T434H | I462H | D436H |
| Q432H | S431H | T434H | I462H | D436H |
| S431H | V440H | Y442H | I462H | D436H |
| Q432H | V440H | Y442H | I462H | D436H |
| Q432H | S431H | Y442H | I462H | D436H |
| T434H | V440H | Y442H | I462H | D436H |
| T434H | S431H | Y442H | I462H | D436H |
| T434H | Q432H | Y442H | I462H | D436H |
| S431H | V440H | Q432H | D435H | D436H |
| S431H | V440H | T434H | D435H | D436H |
| Q432H | V440H | T434H | D435H | D436H |
| Q432H | S431H | T434H | D435H | D436H |
| S431H | V440H | Y442H | D435H | D436H |
| Q432H | V440H | Y442H | D435H | D436H |
| Q432H | S431H | Y442H | D435H | D436H |
| T434H | V440H | Y442H | D435H | D436H |
| T434H | S431H | Y442H | D435H | D436H |
| T434H | Q432H | Y442H | D435H | D436H |
| S431H | V440H | I462H | D435H | D436H |
| Q432H | V440H | I462H | D435H | D436H |
| Q432H | S431H | I462H | D435H | D436H |
| T434H | V440H | I462H | D435H | D436H |
| T434H | S431H | I462H | D435H | D436H |
| T434H | Q432H | I462H | D435H | D436H |
| Y442H | V440H | I462H | D435H | D436H |
| Y442H | S431H | I462H | D435H | D436H |
| Y442H | Q432H | I462H | D43SH | D436H |
| Y442H | T434H | I462H | D435H | D436H |
| S431H | V440H | Q432H | T434H | I439H |
| S431H | V440H | Q432H | Y442H | I439H |
| S431H | V440H | T434H | Y442H | I439H |
| Q432H | V440H | T434H | Y442H | I439H |
| Q432H | S431H | T434H | Y442H | I439H |
| S431H | V440H | Q432H | T434H | K438H |
| S431H | V440H | Q432H | I462H | I439H |
| S431H | V440H | T434H | I462H | I439H |
| S431H | V440H | Q432H | Y442H | K438H |
| Q432H | V440H | T434H | I462H | I439H |
| S431H | V440H | T434H | Y442H | K438H |
| Q432H | S431H | T434H | I462H | I439H |
| Q432H | V440H | T434H | Y442H | K438H |
| Q432H | S431H | T434H | Y442H | K438H |
| S431H | V440H | Y442H | I462H | I439H |
| Q432H | V440H | Y442H | I462H | I439H |
| Q432H | S431H | Y442H | I462H | I439H |
| T434H | V440H | Y442H | I462H | I439H |
| T434H | S431H | Y442H | I462H | I439H |
| T434H | Q432H | Y442H | I462H | I439H |
| S431H | V440H | Q432H | D435H | I439H |
| S431H | V440H | T434H | D435H | I439H |
| Q432H | V440H | T434H | D435H | I439H |
| Q432H | S431H | T434H | D435H | I439H |
| S431H | V440H | Y442H | D435H | I439H |
| Q432H | V440H | Y442H | D435H | I439H |
| Q432H | S431H | Y442H | D435H | I439H |
| T434H | V440H | Y442H | D43SH | I439H |
| T434H | S431H | Y442H | D435H | I439H |
| T434H | Q432H | Y442H | D435H | I439H |
| S431H | V440H | Q432H | D436H | I439H |
| S431H | V440H | T434H | D436H | I439H |
| Q432H | V440H | T434H | D436H | I439H |
| Q432H | S431H | T434H | D436H | I439H |
| S431H | V440H | Q432H | I462H | K438H |
| S431H | V440H | T434H | I462H | K438H |
| Q432H | V440H | T434H | I462H | K438H |
| Q432H | S431H | T434H | I462H | K438H |
| S431H | V440H | Y442H | D436H | I439H |
| Q432H | V440H | Y442H | D436H | I439H |
| Q432H | S431H | Y442H | D436H | I439H |
| T434H | V440H | Y442H | D436H | I439H |
| T434H | S431H | Y442H | D436H | I439H |
| T434H | Q432H | Y442H | D436H | I439H |
| S431H | V440H | Y442H | I462H | K438H |
| Q432H | V440H | Y442H | I462H | K438H |
| Q432H | S431H | Y442H | I462H | K438H |
| T434H | V440H | Y442H | I462H | K438H |
| T434H | S431H | Y442H | I462H | K438H |
| T434H | Q432H | Y442H | I462H | K438H |
| S431H | V440H | Q432H | D43SH | K438H |
| S431H | V440H | T434H | D435H | K438H |
| Q432H | S431H | T434H | D435H | K438H |
| S431H | V440H | I462H | D435H | I439H |
| Q432H | V440H | I462H | D435H | I439H |
| S431H | V440H | Y442H | D435H | K438H |
| Q432H | S431H | I462H | D435H | I439H |
| T434H | V440H | I462H | D435H | I439H |
| Q432H | V440H | Y442H | D435H | K438H |
| T434H | S431H | I462H | D435H | I439H |
| Q432H | S431H | Y442H | D435H | K438H |
| T434H | V440H | Y442H | D435H | K438H |
| T434H | Q432H | I462H | D435H | I439H |
| T434H | S431H | Y442H | D435H | K438H |
| T434H | Q432H | Y442H | D435H | K438H |
| Y442H | V440H | I462H | D435H | I439H |
| Y442H | S431H | I462H | D43SH | I439H |
| Y442H | Q432H | I462H | D435H | I439H |
| Y442H | T434H | I462H | D435H | I439H |
| S431H | V440H | Q432H | D436H | K438H |
| S431H | V440H | T434H | D436H | K438H |
| Q432H | V440H | T434H | D436H | K438H |
| Q432H | S431H | T434H | D436H | K438H |
| S431H | V440H | I462H | D436H | I439H |
| Q432H | V440H | I462H | D436H | I439H |
| S431H | V440H | Y442H | D436H | K438H |
| Q432H | S431H | I462H | D436H | I439H |
| T434H | V440H | I462H | D436H | I439H |
| Q432H | V440H | Y442H | D436H | K438H |
| T434H | S431H | I462H | D436H | I439H |
| Q432H | S431H | Y442H | D436H | K438H |
| T434H | V440H | Y442H | D436H | K438H |
| T434H | Q432H | I462H | D436H | I439H |
| T434H | S431H | Y442H | D436H | K438H |
| T434H | Q432H | Y442H | D436H | K438H |
| Y442H | V440H | I462H | D436H | I439H |
| Y442H | S431H | I462H | D436H | I439H |
| Y442H | Q432H | I462H | D436H | I439H |
| Y442H | T434H | I462H | D436H | I439H |
| S431H | V440H | D435H | D436H | I439H |
| Q432H | V440H | D435H | D436H | I439H |
| Q432H | S431H | D435H | D436H | I439H |
| T434H | V440H | D435H | D436H | I439H |
| T434H | S431H | D435H | D436H | I439H |
| T434H | Q432H | D435H | D436H | I439H |
| S431H | V440H | I462H | D43SH | K438H |
| Q432H | V440H | I462H | D435H | K438H |
| Q432H | S431H | I462H | D435H | K438H |
| T434H | V440H | I462H | D435H | K438H |
| T434H | S431H | I462H | D435H | K438H |
| T434H | Q432H | I462H | D435H | K438H |
| Y442H | V440H | D435H | D436H | I439H |
| Y442H | S431H | D435H | D436H | I439H |
| Y442H | Q432H | D435H | D436H | I439H |
| Y442H | T434H | D435H | D436H | I439H |
| Y442H | V440H | I462H | D435H | K438H |
| Y442H | S431H | I462H | D435H | K438H |

TABLE 4-continued

| Combinations of Mutations | | | | |
|---|---|---|---|---|
| Mutation 1 | Mutation 2 | Mutation 3 | Mutation 4 | Mutation 5 |
| Y442H | Q432H | I462H | D435H | K438H |
| Y442H | T434H | I462H | D435H | K438H |
| S431H | V440H | I462H | D436H | K438H |
| Q432H | V440H | I462H | D436H | K438H |
| Q432H | S431H | I462H | D436H | K438H |
| T434H | V440H | I462H | D436H | K438H |
| T434H | S431H | I462H | D436H | K438H |
| T434H | Q432H | I462H | D436H | K438H |
| Y442H | V440H | I462H | D436H | K438H |
| Y442H | S431H | I462H | D436H | K438H |
| Y442H | Q432H | I462H | D436H | K438H |
| Y442H | T434H | I462H | D436H | K438H |
| S431H | V440H | D435H | D436H | K438H |
| Q432H | V440H | D435H | D436H | K438H |
| Q432H | S431H | D435H | D436H | K438H |
| T434H | V440H | D435H | D436H | K438H |
| T434H | S431H | D435H | D436H | K438H |
| T434H | Q432H | D435H | D436H | K438H |
| I462H | V440H | D435H | D436H | I439H |
| I462H | S431H | D435H | D436H | I439H |
| Y442H | V440H | D435H | D436H | K438H |
| I462H | Q432H | D435H | D436H | I439H |
| Y442H | S431H | D435H | D436H | K438H |
| I462H | T434H | D435H | D436H | I439H |
| Y442H | Q432H | D435H | D436H | K438H |
| Y442H | T434H | D435H | D436H | K438H |
| I462H | Y442H | D435H | D436H | I439H |
| I462H | V440H | D435H | D436H | K438H |
| I462H | S431H | D435H | D436H | K438H |
| I462H | Q432H | D435H | D436H | K438H |
| I462H | T434H | D435H | D436H | K438H |
| I462H | Y442H | D435H | D436H | K438H |
| S431H | V440H | Q432H | I439H | K438H |
| S431H | V440H | T434H | I439H | K438H |
| Q432H | V440H | T434H | I439H | K438H |
| Q432H | S431H | T434H | I439H | K438H |
| S431H | V440H | Y442H | I439H | K438H |
| Q432H | V440H | Y442H | I439H | K438H |
| Q432H | S431H | Y442H | I439H | K438H |
| T434H | V440H | Y442H | I439H | K438H |
| T434H | S431H | Y442H | I439H | K438H |
| T434H | Q432H | Y442H | I439H | K438H |
| S431H | V440H | I462H | I439H | K438H |
| Q432H | V440H | I462H | I439H | K438H |
| Q432H | S431H | I462H | I439H | K438H |
| T434H | V440H | I462H | I439H | K438H |
| T434H | S431H | I462H | I439H | K438H |
| T434H | Q432H | I462H | I439H | K438H |
| Y442H | V440H | I462H | I439H | K438H |
| Y442H | S431H | I462H | I439H | K438H |
| Y442H | Q432H | I462H | I439H | K438H |
| Y442H | T434H | I462H | I439H | K438H |
| S431H | V440H | D435H | I439H | K438H |
| Q432H | V440H | D435H | I439H | K438H |
| Q432H | S431H | D435H | I439H | K438H |
| T434H | V440H | D435H | I439H | K438H |
| T434H | S431H | D435H | I439H | K438H |
| T434H | Q432H | D435H | I439H | K438H |
| Y442H | V440H | D435H | I439H | K438H |
| Y442H | S431H | D435H | I439H | K438H |
| Y442H | Q432H | D435H | I439H | K438H |
| Y442H | T434H | D435H | I439H | K438H |
| S431H | V440H | D436H | I439H | K438H |
| Q432H | V440H | D436H | I439H | K438H |
| Q432H | S431H | D436H | I439H | K438H |
| T434H | V440H | D436H | I439H | K438H |
| T434H | S431H | D436H | I439H | K438H |
| T434H | Q432H | D436H | I439H | K438H |
| Y442H | V440H | D436H | I439H | K438H |
| Y442H | S431H | D436H | I439H | K438H |
| Y442H | Q432H | D436H | I439H | K438H |
| Y442H | T434H | D436H | I439H | K438H |
| I462H | V440H | D435H | I439H | K438H |
| I462H | S431H | D435H | I439H | K438H |
| T462H | Q432H | D435H | I439H | K438H |
| I462H | T434H | D435H | I439H | K438H |

TABLE 4-continued

| Combinations of Mutations | | | | |
|---|---|---|---|---|
| Mutation 1 | Mutation 2 | Mutation 3 | Mutation 4 | Mutation 5 |
| I462H | Y442H | D435H | I439H | K438H |
| I462H | V440H | D436H | I439H | K438H |
| I462H | S431H | D436H | I439H | K438H |
| I462H | Q432H | D436H | I439H | K438H |
| I462H | T434H | D436H | I439H | K438H |
| I462H | Y442H | D436H | I439H | K438H |
| D435H | V440H | D436H | I439H | K438H |
| D435H | S431H | D436H | I439H | K438H |
| D435H | Q432H | D436H | I439H | K438H |
| D435H | T434H | D436H | I439H | K438H |
| D435H | Y442H | D436H | I439H | K438H |
| D435H | I462H | D436H | I439H | K438H |

In some embodiments, the AAV-binding polypeptide comprises SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and 154H. In some embodiments, the AAV-binding polypeptide comprises SEQ ID NO: 29 with V32H and V34H mutations. In some embodiments, the AAV-binding polypeptide comprises SEQ ID NO: 29 with S23H and Q24H mutations. In some embodiments, the AAV-binding polypeptide comprises SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and I54H. In some embodiments, the AAV-binding polypeptide comprises an amino acid sequence of any one of SEQ ID NO: 76-86.

In some embodiments, the AAV-binding polypeptide comprises SEQ ID NO: 29 with an additional five amino acids at the N-terminus having an amino acid sequence of GNRPP (SEQ ID NO: 89), and an additional five amino acids at the C-terminus having an amino acid sequence of VDYPG (SEQ ID NO: 90). In some embodiments, the AAV-binding polypeptide comprises an amino acid sequence of SEQ ID NO: 52. In some embodiments, the AAV-binding polypeptide comprises SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and I54H and an additional five amino acids at the N-terminus having an amino acid sequence of GNRPP (SEQ ID NO: 89), and an additional five amino acids at the C-terminus having an amino acid sequence of VDYPG (SEQ ID NO: 90). Tn some embodiments, the AAV-binding polypeptide comprises SEQ ID NO: 52 with at least one, at least two, at least three, at least four, or at least five mutations, wherein each mutation is individually selected from the group consisting of S23H, Q24H, T26H, D29H, K30H, I31H, V32H, Y34H, and I54H.

In some embodiments, the AAV-binding polypeptide is encoded by a nucleic acid sequence of any one of SEQ ID NO: 93-116. In some embodiments, the AAV-binding polypeptide comprises SEQ ID NO: 29 with V32H and V34H mutations and an additional five amino acids at the N-terminus having an amino acid sequence of GNRPP (SEQ ID NO: 89), and an additional five amino acids at the C-terminus having an amino acid sequence of VDYPG (SEQ ID NO: 90). In some embodiments, the AAV-binding polypeptide comprises SEQ ID NO: 29 with S23H and Q24H mutations and an additional five amino acids at the N-terminus having an amino acid sequence of GNRPP (SEQ ID NO: 89), and an additional five amino acids at the C-terminus having an amino acid sequence of VDYPG (SEQ ID NO: 90). In some embodiments, the AAV-binding polypeptide comprising SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and 154H and an additional five amino acids at the N-terminus having an amino acid sequence of GNRPP (SEQ ID NO: 89), and an additional five amino acids at the C-terminus having an amino acid sequence of VDYPG (SEQ ID NO: 90). In some embodiments, the AAV-binding polypeptide comprises an amino acid sequence of any one of SEQ ID NOs: 53-63.

In some embodiments, the AAV-binding polypeptide comprises an amino acid sequence of SEQ ID NO; 29, plus an additional five amino acids at the N-terminus having an amino acid sequence of GNRPP (SEQ ID NO: 89), and an additional four amino acids at the C-terminus having an amino acid sequence of VDYP (SEQ ID NO: 91). In some embodiments, the AAV-binding polypeptide comprises an amino acid sequence of SEQ ID NO: 64. In some embodiments, the AAV-binding polypeptide comprises an amino acid sequence of SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and I54K and an additional five amino acids at the N-terminus having an amino acid sequence of GNRPP (SEQ ID NO: 89), and an additional four amino acids at the C-terminus having an amino acid sequence of VDYP (SEQ ID NO: 91). In some embodiments, the AAV-binding polypeptide comprises SEQ ID NO: 29 plus V32H and V34H mutations and an additional five amino acids at the N-terminus having an amino acid sequence of GNRPP (SEQ ID NO: 89), and an additional four amino acids at the C-terminus having an amino acid sequence of VDYP (SEQ ID NO: 91). In some embodiments, the AAV-binding polypeptide comprises SEQ ID NO: 29 with S23H and Q24H mutations and an additional five amino acids at the N-terminus having an amino acid sequence of GNRPP (SEQ ID NO: 89), and an additional four amino acids at the C-terminus having an amino acid sequence of VDYP (SEQ ID NO: 91). In some embodiments, the AAV-binding polypeptide comprises an amino acid sequence of SEQ ID NO: 29 with at least one, at least two, at least three, at least four, or at least five mutations, wherein each mutation is individually selected from the group consisting of S23H, Q24H, T26H, D29H, K30H, I31H, V32H, Y34H, and 154H and an additional five amino acids at the N-terminus having an amino acid sequence of GNRPP (SEQ ID NO: 89), and an additional four amino acids at the C-terminus having an amino acid sequence of VDYP (SEQ ID NO; 91). In some embodiments, the AAV-binding polypeptide comprises an amino acid sequence of any one of SEQ ID NOS: 65-75.

In some embodiments, the AAV-binding polypeptides described herein comprise one or more MANEC motifs (See, e.g., SEQ ID NOS: 49-51). In some embodiments, the AAV-binding polypeptides described herein comprise one or more recombinant MANEC motifs. In some embodiments, the AAV-binding polypeptides described herein comprise an amino acid sequence with at least about 80%, at least about 90°/%, at least about 95, or at least about 95% identity to a wild type MANEC motif. In some embodiments, the AAV-binding polypeptides comprise a MANEC motif having at least about 80%, at least about 90% or at least about 95% identity to any one of SEQ ID NOs: 49-51. In some embodiments, the AAV-binding polypeptides bind to AAV particles via one or more MANEC motifs.

In some embodiments, the AAV-binding polypeptides described herein comprise an N-terminal methionine. In some embodiments, the N-terminal methionine initiates translation of an AAV-binding polypeptide described herein. In some embodiments, the AAV-binding polypeptides described herein lack an N-terminal methionine.

In some embodiments, the AAV-binding polypeptides described herein bind to AAV particles of the following serotypes: AAV1, AAV2, AAV3, AAV4, AAV5, AAV6, AAV7, AAV8, AAV9, AAV10, AAV11, AAV12, AAVrh8, AAVrh10, and/or AAVrh74. In some embodiments, the AAV-binding polypeptides bind to AAV particles of one or more of the following serotypes: AAV1, AAV2, AAV3B, AAV5, AAV6, AAV8, and AAV9. In some embodiments, the AAV-binding polypeptides bind to AAV1 particles. In some embodiments, the AAV-binding polypeptides bind to AAV2 particles. In some embodiments, the AAV-binding polypeptides bind to AAV3B particles. In some embodiments, the AAV-binding polypeptides bind to AAV5 particles. In some embodiments, the AAV-binding polypeptides bind to AAV6 particles. In some embodiments, the AAV-binding polypeptides bind to AAV8 particles. In some embodiments, the AAV-binding polypeptides bind to AAV9 particles.

In some embodiments, the AAVR is the human AAVR. In some embodiments, the AAVR is a primate AAVR. In some embodiments, the AAVR is a wildtype AAVR. In some embodiments, the AAVR is a mutant AAVR In some embodiments, the AAVR is a glycoprotein. In some embodiments, the AAV-binding polypeptides described herein comprise one or more glycosylation sites. In some embodiments, the AAV-binding polypeptides comprise O-linked glycosylation sites. In some embodiments, the AAV-binding polypeptides comprise N-linked glycosylation sites. In some embodiments, the AAVR comprises N-linked glycosylation. In some embodiments, the AAVR is glycosylated at one or more asparagine and/or glutamine residues.

In some embodiments, a purification matrix comprises from about 1 to about 100 AAV-binding polypeptides. In some embodiments, the number of AAV-binding polypeptides is about 1, about 5, about 10, about 20, about 30, about 40, about 50, about 55, about 60, about 65, about 70, about 75, about 80, about 85, about 90, about 95, or about 100. In some embodiments, a single polypeptide with phase behavior may be coupled to multiple AAV-binding polypeptides, such as about 1 to about 100 AAV-binding polypeptides.

In some embodiments, the AAV-binding polypeptide comprises a sequence of any one of SEQ ID NOS: 28-34, 37-41, 43-47, and 52-86. In some embodiments wherein a single polypeptide with phase behavior is coupled to multiple AAV-binding polypeptides, each AAV-binding polypeptide may be independently selected from SEQ ID NOS: 28-34, 37-41, 43-47, and 52-86.

In some embodiments, a nucleic acid encodes one or more AAV binding polypeptides described herein. In some embodiments, a vector comprises a nucleic acid that encodes one or more AAV binding polypeptides described herein.

In some embodiments, a kit comprises an AAV binding polypeptide, a nucleic acid encoding an AAV binding polypeptide, and/or a vector comprising a nucleic acid encoding an AAV binding polypeptide.

In some embodiments, a purification matrix comprises an AAV-binding polypeptide. In some embodiments, a kits comprises a purification matrix.

In some embodiments, the AAV-binding polypeptides described herein bind to one or more AAV particles. In some embodiments, purification matrices that comprise an AAV-binding polypeptide bind to one or more AAV particles.

In some embodiments, the AAV-binding polypeptides have a $K_d$ from about 1 nM to about 500 nM. In some embodiments, the AAV-binding polypeptides have a $K_d$ of about 1 nM, about 2 nM, about 3 nM, about 4 nM, about 5 nM, about 6 nM, about 7 nM, about 8 nM, about 9 nM, about 10 nM, about 20 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, about 300 nM, about 310 nM, about 320 nM, about 330 nM, about 340 nM, about 350 nM, about 360 nM, about 370 nM, about 380 nM, about 390 nM, about 400 nM, about 410 nM, about 420 nM, about 430 nM, about 440 nM, about 450 nM, about 460 nM, about 470 nM, about 480 nM, about 490 nM, or about 500 nM, including all values and ranges in between. In some embodiments, the AAV-binding polypeptides have an affinity of 50 nM or greater. In some embodiments, the AAV-binding polypeptides have an affinity of about 50 nM, about 40 nM, about 30 nM, about 20 nM, about 2 nM, about 1 nM, about 0.1 nM, about 0.01 nM, about 0.001 nM.

In some embodiments, the binding of the AAV-binding polypeptides to an AAV particle is disrupted at a pH of 2.5 or higher. In some embodiments, the binding of the AAV-binding polypeptides to an AAV particle is disrupted at a pH of about 2.5, about 3.0, about 3.5, about 4.0, about 4.5, about 5.0, about 5.5, about 6.0, about 6.5, about 7.0, about 7.5, about 8.0, about 8.5, about 9.0, about 9.5, about 10.0, about 10.5, about 11.0, about 11.5, about 12.0, about 12.5, about 13.0, or about 13.5.

Support

In some embodiments, the disclosure provides a purification matrix comprising an AAV-binding polypeptide that is coupled to a support (e.g., a solid support). In some embodiments, the disclosure provides a purification matrix comprising an AAV-binding polypeptide and a peptide having phase behavior that is coupled to a support. In some embodiments, the support is a bead, resin, plate, chip, a membrane, a fiber, or a polymer. In some embodiments, the support comprises silica, agarose, soft agarose, cellulose, cellulose acetate, polystyrene, sepharose, heparin sepharose, celluline sulfate, hydroxyapatite, ceramic hydroxyapatite, agarose, dextran, latex, polymethacrylate, polyacrylamide, nitrocellulose, nylon, polyester, polyethersulfone, poly(styrenedivinyl)benzene, ceramic particles, polyacrylamide, polyolefin, and/or polyvinylidene fluoride, sulphopropyl immobilized on agarose, and/or combinations thereof.

In some embodiments, the support is a polymer. Non-limiting examples of polymers include polyamylic acid, polyacrlonitrile, polyallyamine, polyacrylates, polybutyl acrylate, polymethylmethacrylate, polyalkyl acrylates, polyalkyl methacrylate, polybutadiene, polycarbomethylsilane, polystyrene, polypeptides, polynucleic acids, and poly(carbonate) urethane. In some embodiments, the support is a synthetic polymer. In some embodiments, the support is a recombinant polymer.

In some embodiments, the support is a resin. In some embodiments, the resin is positively charged. In some embodiments, a cation is attached to the resin. In some embodiments, the cation is a quaternary amino group. In some embodiments, the positively charged resin comprises diethylaminoethyl cellulose, magnetic amine, magnetic propylamine, magnetic quaternary ammonium, magnetic poly-D-lysine, poly-D-lysine functionalized polyurethane, spermine latex, tris (2-aminoethyl) amine latex, tris (2-aminoethyl) amine beaded agarose, tris (2-aminoethyl)-acrylamide, and tris (2-aminoethyl)polyurethane amine. In some embodiments, the resin is negatively charged. In some embodiments, an anion is attached to the resin. In some embodiments, an anion is covalently attached to the resin. Non-limiting examples of anions include sulfonate or carboxylates.

In some embodiments, the support is porous. In some embodiments, the porous support is a resin or a bead. In some embodiments, the porous support is a magnetic bead. In some embodiments, the porous support has a pore size from about 50 nm to about 5000 nm. In some embodiments, the pore size is about 50 nm, about 100 nm, about 150 nm, about 200 nm, about 300 nm, about 400 nm, about 500 nm, about 600 nm, about 700 nm, about 800 nm, about 900 nm, about 1000 nm, about 1100 nm, about 1200 nm, about 1300 nm, about 1400 nm, about 1500 nm, about 1600 nm, about 1700 nm, about 1800 nm, about 1900 nm, about 2000 nm, about 2100 nm, about 2200 nm, about 2300 nm, about 2400 nm, about 2500 nm, about 2600 nm, about 2700 nm, about 2800 nm, about 2900 nm, about 3000 nm, about 3100 nm, about 3200 nm, about 3300 nm, about 3400 nm, about 3500 nm, about 3600 nm, about 3700 nm, about 3800 nm, about 3900 nm, about 4000 nm, about 4100 nm, about 4200 nm, about 4300 nm, about 4400 nm, about 4500 nm, about 4600 nm, about 4700 nm, about 4800 nm, about 4900 nm, or about 5000 nm. In some embodiments, the pore size is the radius of the pores. In some embodiments, the pore size is the diameter of the pores.

In some embodiments, the support comprises one or more cross-linked materials. In some embodiments, the porous support comprises one or more cross-linked materials. In some embodiments, cross-linking prevents interaction of AAV with the pores of the support. In some embodiments, the support is a static fibrous network. In some embodiments, the support is a solid-state network.

In some embodiments, the support is pretreated prior to coupling to the AAV-binding polypeptide. In some embodiments, the support is pre-treated with RNase solution.

In some embodiments, the support is coupled to the AAV-binding polypeptide via a linker. In some embodiments, the linker is coupled to the support. In some embodiments, the linker is coupled to the AAV-binding polypeptide. Examples of linkers are provided throughout this disclosure.

In some embodiments, the support is separated from solution by decantation, centrifugation or filtration. If the particles are magnetic, magnetic field separation can be used.

In some embodiments, the support is contained in a vessel. Non-limiting examples of vessels include centrifuge tubes, spin tubes, syringes, cartridges, chambers, chips, multiple-well plates, beakers, chromatography columns, or test tubes.

Polypeptide Having Phase Behavior

In some embodiments, the disclosure provides a purification matrix comprising a polypeptide having phase behavior. In some embodiments, the disclosure provides a purification matrix comprising a polypeptide having phase behavior that is coupled to an AAV-binding protein. In some embodiments, the disclosure provides a purification matrix comprising a support that is coupled to fusion protein comprising (i) an AAV-binding protein and (ii) a polypeptide having phase behavior.

In some embodiments, the polypeptide with phase behavior is a resilin-like polypeptide (RLP). Resilin-like polypeptides are elastomeric polypeptides with mechanical properties including desirable resilience, compressive elastic modulus, tensile elastic modulus, shear modulus, extension to break, maximum tensile strength, hardness, rebound, and compression set. In some embodiments, the resilin-like polypeptides described herein are polymers which comprise one or more repeats. In some embodiments, the polymeric repeats may have an amino acid sequence selected from any one of SEQ ID NOS: 1-9.

In some embodiments, a resilin-like polypeptide comprises more than one type of repeat, e.g. a repeat of SEQ ID NO: 1 and a repeat of SEQ ID NO: 3.

In some embodiments, the resilin-like polypeptides described herein comprise repeats that occur up to 500 times within a given RLP. In some embodiments, the repeats occur about 1, about 2, about 3, about 4, about 5, about 6, about 7, about 8, about 9, about 10, about 20, about 30, about 40, about 50, about 60, about 70, about 80, about 90, about 100, about 110, about 120, about 130, about 140, about 150, about 160, about 170, about 180, about 190, about 200, about 210, about 220, about 230, about 240, about 250, about 260, about 270, about 280, about 290, about 300, about 310, about 320, about 330, about 340, about 350, about 360, about 370, about 380, about 390, about 400, about 450, or about 500 times.

In some embodiments, the RLP comprises one or more partial repeats. In some embodiments, the length of a partial repeat is 1, 2, 3, 4, 5, 6, 7, 8, 9, or 10 amino acids. In some embodiments, the RLP comprises one or more additional amino acids at the N-terminus or C-terminus of the RLP that are not part of a repeat.

In some embodiments, one or more RLP repeats are scrambled, i.e., they contain a different amino acid sequence but retain the same amino acid composition. For example, a repeat may have a different amino acid sequence than SEQ ID NO: 8, but retain the same amino acid composition.

In some embodiments, the polypeptide with phase behavior is an elastin-like polypeptide. Elastin-like polypeptides (ELPs) are biopolymers derived from tropoelastin. In some embodiments, the elastin-like polypeptides described herein are polymers comprising a pentapeptide repeat having the sequence (Val-Pro-Gly-Xaa-Gly)$_n$ (SEQ ID NO: 10).

In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, the pentapeptide repeat is scrambled, for example it comprises a different amino acid sequence but maintains the same amino acid composition. For example, an ELP may comprise a different amino acid sequence than SEQ ID NO: 10, but maintains the same amino acid composition, e.g. 40% of the sequence is glycine, 20% of the sequence is Xaa (e.g., any amino acid except proline), 20% of the sequence is proline, and 20% of the sequence is valine.

In some embodiments, the ELP comprises one or more partial repeats. In some embodiments, the length of a partial repeat is 1, 2, 3, or 4 amino acids. In some embodiments, the ELP comprises one or more additional amino acids at the N-terminus or C-terminus of the ELP that are not part of a repeat.

ELPs and RLPs undergo a phase transition in response to an environmental factor. ELPs and RLPs retain their ability to undergo a phase transition when coupled to one or more polypeptides (such as one or more AAV binding polypeptides), or expressed as a fusion protein with one or more other polypeptides (such as one or more AAV binding polypeptides). Polymers like ELPs and RLPs exhibit a transition temperature ($T_t$), also referred to as a cloud point temperature ($T_c$). In some embodiments ELPs and RLPs undergo a reversible phase transition from a soluble to an insoluble phase at the $T_t$. ELPs that transition from a soluble to an insoluble phase with heating or an increase in salt concentration have a $T_t$ referred to as a lower critical solution temperature (LCST). RLPs that transition from a soluble to an insoluble phase with cooling or a decrease in salt concentration have a $T_t$ referred to as a lower critical solution temperature (UCST). In some embodiments, the phase transition results from a change in secondary structure of the ELP and/or RLP. For example, the phase transition of an ELP results from a change in secondary structure from a random coil (below the $T_t$) to a type II β-turn. In some embodiments, the change in secondary structure is characterized by a method selected from circular dichroism spectropolarimetry, small angle x-ray scattering, ultraviolet-visible spectrophotometry, static light scattering, dynamic light scattering, nuclear magnetic resonance spectroscopy, solid-state nuclear magnetic resonance spectroscopy, infrared spectroscopy, Fourier transform infrared spectroscopy (FTIR), small angle neutron scattering, microscopy, and cryo-electron microscopy. In some embodiments, the phase transition of an ELP does not result from a change in secondary structure.

In some embodiments, the RLPs and ELPs described herein have a transition temperature between about 0° C. and about 100° C. In some embodiments, the RLPs and ELPs described herein have a transition temperature between about 10° C. and about 50° C. In some embodiments the transition temperature is about 0° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C., about 46° C., about 47° C., about 48° C., about 49° C., about 50° C., about 51° C., about 52° C., about 53° C., about 54° C., about 55° C., about 56° C., about 57° C., about 58° C., about 59° C., about 60° C., about 61° C., about 62° C., about 63° C., about 64° C., about 65° C., about 66° C., about 67° C., about 68° C., about 69° C., about 70° C., about 71° C., about 72° C., about 73° C., about 74° C., about 75° C., about 76° C., about 77° C., about 78° C., about 79° C., about 80° C., about 81° C., about 82° C., about 83° C., about 84° C., about 85° C., about 86° C., about 87° C., about 88° C., about 89° C., about 90° C., about 91° C., about 92° C., about 93° C., about 94° C., about 95° C., about 96° C., about 97° C., about 98° C., about 99° C., or about 100° C. In some embodiments, the RLPs described herein have a transition temperature from about 10° C. to about 100° C.

In some embodiments, the $T_t$ of the RLPs and ELPs described herein is modulated by manipulating the primary structure (e.g. amino acid sequence) of the RLP and ELP. In some embodiments, the hydrophobicity of the ELP or RLP is modulated. In some embodiments, the hydrophobicity of the ELP is modified by altering the identity of the guest residue Xaa. In some embodiments, the hydrophobicity of the ELP or RLP is increased resulting in a decreased $T_t$. In some embodiments, the hydrophobicity of the ELP or RLP is decreased resulting in an increased $T_t$. In some embodiments, the polarity of the ELP or RLP is modulated. In some embodiments, the polarity of the ELP is modulated by altering the identity of the guest residue Xaa. In some embodiments, the polarity of the ELP or RLP is increased resulting in an increased $T_t$. In some embodiments, the polarity of the ELP or RLP is decreased resulting in a decreased $T_t$.

In some embodiments, the number of ELP pentapeptide repeats (n) is modulated to alter the $T_t$. In some embodiments, n of the pentapeptide repeat (Val-Pro-Gly-Xaa-Gly)$_n$ (SEQ ID NO: 10) is an integer from 1 to 500, inclusive of endpoints. In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, Xaa is a "guest residue," i.e., any amino acid that does not eliminate the phase behavior of the ELP. In some embodiments, Xaa is any amino acid except proline. In some embodiments, Xaa is independently selected for each repeat. For example, a given ELP may comprise the guest residues alanine, glycine, and valine at a ratio of 8:7:1. In some embodiments Xaa is selected from the group consisting of alanine, arginine, asparagine, aspartic acid, cysteine, glutamic acid, glutamine, glycine, histidine, isoleucine, leucine, lysine, methionine, phenylalanine, praline, serine, threonine, tryptophan, tyrosine and valine. In some embodiments, Xaa is a non-classical amino acid selected from Table 2 and/or the group consisting of 2,4-diaminobutyric acid, α-amino-isobutyric acid, alloisoleucine, 4-aminobutyric acid, 2-amino butyric acid (Abu), ε-Ahx, 6-amino hexanoic acid, 2-amino isobutyric acid (Aib), 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, β-alanine, fluoro-amino acids, designer amino acids such as β-methyl amino acids, Cα-methyl amino acids, Na-methyl amino acids, and amino acid analogs in general. In some embodiments, Xaa is the D-isomer of a natural or non-classical amino acid.

In some embodiments, the $T_t$ of the RLPs and ELPs described herein is modulated by introducing one or more environmental factors to the composition comprising the RLP and/or ELP. In some embodiments, the $T_t$ of the ELPs and/or RLPs is modulated by adjusting the ionic strength of solvents. In some embodiments, the ionic strength of the solvent is adjusted by adding salt. In some embodiments, ELPs and/or RLPs comprise lower $T_t$ in solvents comprising anions categorized as kosmotropes. Anions that are kosmotropes are highly hydrated and influence the water shield on ELPs and/or RLPs. In some embodiments, the $T_t$ of ELPs and/or RLPs can be adjusted through the addition of anions that are chaotropes. At low concentrations, the addition of chaotropes increase the $T_t$ of the ELP and/or RLP. At high concentrations, the addition of a chaotrope decreases the $T_t$ of the ELP and/or RLP. In some embodiments, the $T_t$ of the ELP and/or RLP can be tuned by introducing one or more reagents that disrupts hydrogen bonds. Non-limiting examples of reagents that disrupt hydrogen bonds include sodium dodecyl sulfate (SDS) and urea. In some embodiments, reagents that enhance hydrogen bond formation are utilized to modulate the $T_t$. In some embodiments, reagents that enhance hydrophobic interactions are utilized to modulate the $T_t$. Trifluoroethanol is a reagent which enhances both hydrophobic interactions and hydrogen bond formation, causing a decrease in $T_t$.

In some embodiments, the ELP and/or RLP concentration can be adjusted to modulate $T_t$. In some embodiments, a higher ELP and/or RLP concentration results in a reduced $T_t$. In some embodiments, a lower ELP and/or RLP concentration results in an increased $T_t$.

In addition, modulation of pH, light, and ion concentrations also can be utilized to modulate $T_t$.

In some embodiments, modulation of the number of (e.g. addition or removal) charged amino acids (e.g. histidine, lysine, arginine, glutamic acid, aspartic acid, ornithine, or other non-natural charged amino acids) and identity (e.g. positively or negatively charged) enables tuning of the $T_t$ through pH modulation.

In some embodiments, the ELPs and/or RLPs described herein are block copolymers. A block copolymer comprises two or more sequence domains or blocks, in which two or more blocks comprise different properties. Non-limiting examples of properties that can be tuned include hydrophilicity, hydrophobicity, polarity, and secondary structure. In some embodiments, the block copolymer is an amphiphile, e.g. it comprises at least one hydrophobic and at least one hydrophilic block.

In some embodiments, the ELPs and/or RLPs described herein assemble into various morphologies. Non-limiting examples of morphologies include a spherical aggregate, a micelle, a vesicle, a fibril, a nanofibril, a nanotube, and a hydrogel. In some embodiments, the RLPs and/or ELPs described herein assemble into various morphologies after the addition of an environmental factor. In some embodiments, the RLPs and/or ELPs described herein change from one morphology to another morphology after the addition of an environmental factor. In some embodiments, the RLPs and/or ELPs described herein change from one morphology to another morphology after the addition of an AAV particle.

In some embodiments, addition of an environmental factor causes an RLP and/or ELP to undergo a phase transition. In some embodiments, at the RLP and/or ELP phase transition, the RLP and/or ELP converts from one morphology to another morphology.

In some embodiments, a phase transition of an RLP and/or ELP causes the formation of dense, liquid, droplets.

In some embodiments, the polypeptide with phase behavior comprises an amino acid sequence selected from the group consisting of:

```
(a)
                                    (SEQ ID NO: 1)
(GRGDSPY)_n (b)
                                    (SEQ ID NO: 2)
(GRGDSPH)_n (c)
                                    (SEQ ID NO: 3)
(GRGDSPV)_n (d)
                                    (SEQ ID NO: 4)
(GRGDSPYG)_n (e)
                                    (SEQ ID NO: 5)
(RPLGYDS)_n (f)
                                    (SEQ ID NO: 6)
(RPAGYDS)_n (g)
                                    (SEQ ID NO: 7)
(GRGDSYP)_n (h)
                                    (SEQ ID NO: 8)
(GRGDSPYQ)_n (i)
                                    (SEQ ID NO: 9)
(GRGNSPYG)_n (j)
                                    (SEQ ID NO: 11)
(GVGVP)_n;

(k)
                                    (SEQ ID NO: 12)
(GVGVPGLGVPGVGVPGLGVPGVGVP)_m;

(l)
                                    (SEQ ID NO: 13)
(GVGVPGVGVPGAGVPGVGVPGVGVP)_m;

(m)
                                    (SEQ ID NO: 14)
(GVGVPGWGVPGVGVPGWGVPGVGVP)_m;

(n)
                                    (SEQ ID NO: 15)
(GVGVPGVGVPGVGVPGVGVPGVGVPGVGVPGEGVPGFGVPGVGVP)_m;

(o)
                                    (SEQ ID NO: 16)
(GVGVPGVGVPGVGVPGVGVPGVGVPGVGVPGKGVPGFGVPGVGVP)_m;
and (p)
                                    (SEQ ID NO: 17)
(GAGVPGVGVPGAGVPGVGVPGAGVP)_m;
``` or a randomized, scrambled analog thereof;
wherein:
n is an integer in the range of 1-500, inclusive of endpoints; and
m is an integer in the range of 4-25, inclusive of endpoints.

In some embodiments, the polypeptide with phase behavior is (GVGVPGLGVPGVGVPGLGVPGVGVP)_m (SEQ ID NO: 12), wherein m is 16. In some embodiments, the polypeptide with phase behavior comprises an amino acid sequence of (GVGVPGLGVPGVGVPGLGVPGVGVP)_m (SEQ ID NO: 12), wherein m is 16, and up to 10 additional amino acids at the N-terminus or C-terminus. In some embodiments, the polypeptide with phase behavior comprises an amino acid sequence of (GVGVPGLG VPGVGVPGLGVPGVGVP)_m (SEQ ID NO: 12), wherein m is 16, and an additional C-terminal glycine. In some embodiments, the polypeptide with phase behavior comprises an amino acid sequence of (GVGVPGLG VPGVGVPGLGVPGVGVP)_m (SEQ ID NO: 12), wherein m is 16, and an additional N-terminal methionine. In some embodiments, the polypeptide with phase behavior comprises an amino acid sequence of (GVGVPGLG VPGVGVPGLGVPGVGVP)_m (SEQ ID NO: 12), wherein m is 16, and an additional C-terminal glycine and an additional N-terminal methionine.

In some embodiments, the polypeptide with phase behavior has an amino acid sequence of SEQ ID NO: 88.

In some embodiments, the polypeptide with phase behavior comprises an amino acid sequence of (GVGVPGVGVP-GAGVPGVGVPGVGVP)_m (SEQ ID NO: 144) or (GVGVPGVGVPGLGVPGVGVPGVGVP)_m (SEQ ID NO: 146), wherein m is an integer between 2 and 32, inclusive of endpoints. In some embodiments, the polypeptide with phase behavior comprises an amino acid sequence of (GVGVPGVGVPGAGVPGVGVPGVGVP)_m (SEQ ID NO: 144), wherein m is 8 or 16. In some embodiments, the polypeptide with phase behavior comprises an amino acid sequence of (GVGVPGAGVP)_m (SEQ ID NO: 145), wherein m is an integer between 5 and 80, inclusive of endpoints. In some embodiments, the polypeptide with phase behavior comprises an amino acid sequence of (GXGVP)_m (SEQ ID NO: 147), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

In some embodiments, the polypeptide with phase behavior comprises an amino acid sequence selected from

```
(a)
                                    (SEQ ID NO: 143)
(GVGVP)_m;

(b)
                                    (SEQ ID NO: 148)
(ZZPXXXXGZ)_m;

(c)
                                    (SEQ ID NO: 149)
(ZZPXGZ)_m;

(d)
                                    (SEQ ID NO: 150)
(ZZPXXGZ)_m;
or (e)
                                    (SEQ ID NO: 151)
(ZZPXXXGZ)_m,
``` wherein m is an integer between 10 and 160, inclusive of endpoints, wherein X if present is any amino acid except proline or glycine, and wherein Z if present is any amino acid.

In some embodiments, the polypeptide with phase behavior comprises an amino acid sequence of (GVGVP)_m (SEQ ID NO: 143), wherein m is 20, 40, or 80. In some embodiments, the polypeptide with phase behavior comprises an amino acid sequence of $(GRGDXPZX)_m$ (SEQ ID NO: 152) or $(XZPXDGRG)_m$ (SEQ ID NO: 153), wherein X is glutamine or serine, Z is tyrosine or valine, and m is an integer between 10 and 160, inclusive of endpoints.

In some embodiments, the polypeptide with phase behavior comprises a first set of repeat sequences and a second set of repeat sequences. The first set of repeat sequences and the second set of repeat sequences may each individually comprise sequences that are repeated one or more times. In some embodiments, the first set of repeat sequences any/or the second set of repeat sequences comprises a repeating sequence comprising any one of SEQ ID NOs: 1-17 and 143-153. In some embodiments, the polypeptide with phase behavior comprises a first set of repeat sequences and a second set of repeat sequences, wherein the first set of repeat sequences comprises the amino acid sequence of $(GRGDXPZX)_{40}$ (SEQ ID NO: 154) and the second set of repeat sequences comprises the amino acid sequence $(GVGVP)_{80}$ (SEQ ID NO: 155), wherein X is glutamine and Z is tyrosine. In some embodiments, polypeptide with phase behavior comprising a first set of repeat sequences and a second set of repeat sequences comprises the sequence of SEQ ID NO: 156. In some embodiments, the polypeptide with phase behavior comprises at least one, at least two, at least three, at least four, at least five, at least six, at least seven, at least eight, at least nine, or at least ten different sets of repeat sequences. In some embodiments, each set of repeat sequences within the polypeptide with phase behavior comprises sequences that repeat from about 5 to about 400 time, for example, about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 235, about 240, about 245, about 250, about 255, about 260, about 265, about 270, about 275, about 280, about 285, about 290, about 295, about 300, about 305, about 310, about 315, about 320, about 325, about 330, about 335, about 340, about 345, about 350, about 355, about 360, about 365, about 370, about 375, about 380, about 385, about 390, about 395, or about 400 times.

In some embodiments, the polypeptide with phase behavior comprising an amino acid sequence selected from any one of SEQ ID NOs: 1-17, 88, and 143-153 also comprises up to 10 additional N-terminal and/or C-terminal amino acids. In some embodiments, the polypeptide with phase behavior comprising an amino acid sequence of any one of SEQ ID NOs: 1-17, 88, and 143-153 also comprises an additional N-terminal methionine. In some embodiments, the polypeptide with phase behavior comprising an amino acid sequence of any one of SEQ ID NOs: 1-17, 88, and 143-153 also comprises an additional C-terminal glycine.

In some embodiments, the polypeptide with phase behavior has the same amino acid composition of an ELP and/or RLP but does not comprise repeats. In some embodiments, the polypeptide with phase behavior comprises an amino acid sequence that is about 80%, about 85%, about 90%, about 95%, about 96%, about 97%, about 98%, about 99%, or about 100% identical to an ELP and/or RLP. In some embodiments, the polypeptide with phase behavior comprises an amino acid composition that is about 80%, about 85%, about 90%, about 95%, about 96%, about 97%, about 98%, about 99%, or about 100% identical to an ELP and/or RLP. In some embodiments, the polypeptide with phase behavior comprises a composition of hydrophobic amino acids that is about 80%, about 85%, about 90%, about 95%, about 96%, about 97%, about 98%, about 99%, or about 100% identical to an ELP and/or RLP.

In some embodiments, the polypeptide with phase behavior comprises a non-repetitive unstructured polypeptide. In some embodiments, the non-repetitive unstructured polypeptide has an amino acid sequence that comprises at least 50 amino acids. In some embodiments, the non-repetitive unstructured polypeptide has an amino acid sequence that comprises at least 50, at least 60, at least 70, at least 80, at least 90, or at least 100 amino acids. In some embodiments, the sequence of the non-repetitive unstructured polypeptide is at least about 10% proline (e.g., at least 10%, at least 20%, at least 30%, at least 40%, at least 50%, at least 60%, at least 70%, or at least 80%) and at least 20% glycine (e.g. at least 20%, at least 30%, at least 40%, at least 50%, at least 60%, at least 70%, at least 80%, or at least 90%). In some embodiments, the non-repetitive unstructured polypeptide has a sequence that comprises at least about 40% of amino acids selected from the group consisting of valine, alanine, leucine, lysine, threonine, isoleucine, tyrosine, serine, and phenylalanine.

In some embodiments, the non-repeated unstructured polypeptide comprises a sequence that does not comprise three contiguous identical amino acids, wherein any 5-10 amino acid subsequence does not occur more than once in the non-repeated unstructured polypeptide, and wherein when the non-repeated unstructured polypeptide comprises a subsequence starting and ending with proline, and wherein the subsequence further comprises at least one glycine.

In some embodiments, the ELPs and/or RLPs described herein are expressed as a component of a fusion protein. In some embodiments, a fusion protein comprises an ELP and/or an RLP and an AAV-binding polypeptide such as an AAVR ecodomain or a fragment or derivative thereof. In some embodiments, the fusion protein is expressed in bacteria or mammalian cells. In some embodiments, the fusion protein is expressed in *Escherichia coli*. In some embodiments, the fusion protein is expressed in insect cells. In some embodiments, the sequence of the non-repetitive unstructured polypeptide is at least about 10% proline (e.g. at least $10^1$%, at least 20%, at least 30%, at least 40%) and at least 20% glycine (e.g. at least 20%, at least 30%, at least 40%, or at least 50%), and at least 40% (e.g. at least 40%, at least 50%, at least 60%, or at least 70%) of amino acids selected from the group consisting of valine, alanine, leucine, lysine, threonine, isoleucine, tyrosine, serine, and phenylalanine.

In some embodiments, the non-repetitive unstructured polypeptide does not comprise three contiguous identical amino acids. In some embodiments, the non-repetitive unstructured polypeptide comprises a subsequence (e.g., a fragment of the non-repetitive unstructured polypeptide) which only occurs once in the non-repetitive unstructured polypeptide sequence. In some embodiments, the non-repetitive unstructured polypeptide comprises a subsequence that starts and ends with proline. In some embodiments, the non-repetitive unstructured polypeptide comprises a subsequence that comprises at least one glycine.

In some embodiments, the polypeptide with phase behavior comprises an amino acid sequence of $(GVGVPGLGVPGVGVPGLGVPGVGVP)_m$ (SEQ ID NO: 12), wherein m is 16. In some embodiments, the polypeptide with phase behavior comprises an amino acid sequence of SEQ ID NO; 170.

In some embodiments, the polypeptide with phase behavior comprises a signal peptide.

Binding of AAV to a Purification Matrix

In some embodiments, the present disclosure provides purification matrices comprising an AAV binding polypeptide, wherein the AAV binding polypeptide is coupled to a polypeptide with phase behavior and/or a support.

In some embodiments, the present disclosure provides purification matrices comprising a fusion protein comprising (i) an AAV binding polypeptide and (ii) a polypeptide with phase behavior, wherein the fusion protein is coupled to a support (e.g., a solid support). In some embodiments, the fusion protein is coupled to the support via a residue in the AAV binding polypeptide. In some embodiments, the fusion protein is coupled to the support via a residue in the polypeptide with phase behavior. In some embodiments, the fusion protein is coupled to the support via a residue in a linker between the AAV binding polypeptide and the support. In some embodiments, the binding and/or coupling to the support is reversible.

In some embodiments, a purification matrix is contacted with an AAV particle. In some embodiments, a purification matrix binds to an AAV particle to form a complex. In some embodiments, a purification matrix comprising a fusion protein comprising (i) an AAV binding polypeptide and (ii) a polypeptide with phase behavior binds to an AAV particle to form a complex. In some embodiments, a purification matrix comprising a fusion protein comprising (i) an AAV binding polypeptide and (ii) a polypeptide with phase behavior binds to an AAV particle to form a complex.

In some embodiments, a purification matrix reversibly binds to an AAV. Reversible binding and/or reversible coupling means that the complexes can dissociate e.g. separate into individual components. For example, if a complex reversibly forms between the purification matrix and AAV particle, the purification matrix and AAV particle can subsequently dissociate. In some embodiments, reversible binding allows for separation of AAV particle from the purification matrix. In some embodiments, dissociation is triggered by an environmental factor. In some embodiments, reversible binding allows for separation of a contaminant and/or impurity from the purification matrix. In some embodiments, reversible binding allows for separation of the other molecule from the purification matrix.

In some embodiments, reversible binding is non-covalent, i.e. no covalent bonds are formed between the interacting components of the complex (such as between the purification matrix and the contaminant, biologic, and/or other molecule). In some embodiments, non-covalent interactions cause the purification matrix and the contaminant, biologic, and/or other molecule to bind to each other. Non-limiting examples of non-covalent interactions include dipole-dipole forces, van der Waals forces, London Dispersion forces, hydrogen bonding, hydrophobic interactions, and electrostatic interactions. In some embodiments, non-covalent binding is disrupted by the addition of an environmental factor.

In some embodiments, binding between the purification matrix and an AAV particle is covalent. In some embodiments, a covalent bond between a purification matrix and an AAV particle may be cleaved using, for example, a protease.

In some embodiments, the purification matrix is recyclable, meaning that it can be reused after one or more uses. In some embodiments, the purification matrix is regenerated after a first use, before it is used again. In some embodiments, the purification matrix is regenerated by incubating the purification matrix with guanidine hydrochloride. In some embodiments, the purification matrix is regenerated by incubating the purification matrix in guanidine hydrochloride at a concentration in the range of about 1 M to about 10 M, such as about 6 M. In some embodiments, the purification matrix is regenerated by incubating the purification matrix in sodium hydroxide. In some embodiments, the purification matrix is regenerated by incubating the purification matrix in sodium hydroxide at a concentration in the range of about 0.1 M to about 10 M, such as about 1M. The incubation may be, for example, about 1 to about 30 minutes, about 5 to about 10 minutes, or about 10 to about 10 minutes long. In some embodiments, the incubation is about five minutes long.

In some embodiments, the purification matrix is regenerated by incubating the purification matrix at an elevated temperature, such a temperature greater than 80° C., greater than 85° C., greater than 90° C., greater than 95° C., or greater than 100° C. The incubation may be, for example, about 1 to about 30 minutes, about 5 to about 10 minutes, or about 10 to about 10 minutes long. In some embodiments, the incubation is about five minutes long. In some embodiments, the purification matrix is regenerated by incubating the purification matrix at 95° C. for about five minutes.

In some embodiments, after purification of an AAV particle from a first composition comprising an AAV particle, the purification matrix is regenerated and used for capture of an AAV particle from an additional composition comprising an AAV particle. In some embodiments, the purification matrix can be reused for at least 5 cycles of purification, for example, at least about 5 cycles, at least about 6 cycles, at least about 7 cycles, at least about 8 cycles, at least about 9 cycles, at least about 10 cycles. Each cycle of purification refers to use of a purification matrix to purify an AAV particle from a composition comprising an AAV particle. Subsequent cycles refer to additional use of the same purification matrix to purify an AAV particle from additional compositions comprising an AAV particle. For example, in the third cycle of purification, the purification matrix is used for a third time to purify an AAV particle from a third composition comprising an AAV particle; the same purification matrix was previously used in a first cycle to purify an AAV particle from a first composition comprising an AAV particle and in a second cycle to purify an AAV particle from a second composition comprising an AAV particle.

In some embodiments, the purification matrix retains the ability to capture at least 95% of AAV particles from a composition after at least five purification cycles.

Linkers

In some embodiments, the AAV-binding polypeptide is coupled to the polypeptide with phase behavior or support via a linker. In some embodiments, any linker that does not interfere with the function of the purification matrix may be utilized.

In some embodiments, the linker connects the AAV-binding polypeptide to the polypeptide with phase behavior. In some embodiments, the linker enables cooperative interactions between the polypeptide with phase behavior and the AAV-binding polypeptide. In some embodiments, the linker is a peptide. In some embodiments, the linker preserves the phase behavior of the polypeptide with phase behavior. In some embodiments, the linker preserves the $T_t$ of the polypeptide with phase behavior. In some embodiments, the linker preserves the structure of the capture domain. In some embodiments, the linker comprises between 1 and 50 amino acids. In some embodiments, the linker comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids.

In some embodiments, the stiffness of the linker is increased by the inclusion of proline in the linker amino acid sequence.

In some embodiments, the flexibility of a linker is increased by the inclusion of small polar amino acids, including threonine, serine, and glycine.

In some embodiments, the linker may adopt various secondary structures, including but not limited to α-helices, β-strands, and random coils. In some embodiments, the linker adopts an α-helix and comprises an amino acid repeat of $(EAAAK)_n$ (SEQ ID NO; 18) where n is a repeat number from 1 to 20.

In some embodiments, the linker is comprised of $(G_4S)_n$ (SEQ ID NO: 19) where n can be an integer from 1 to 30 (e.g. 1, 2, 3, 4, 5, 6, 7, 8, 9, 10, 11, 12, 13, 14, 15, 16, 17, 18, 19, 20). In embodiments, the polypeptide linker has a repeat of $(SGGG)_n$ (SEQ ID NO: 20), wherein n is an integer from 1 to 50 (e.g. 1, 2, 3, 4, 5, 6, 7, 8, 9, 10, 11, 12, 13, 14, 15, 16, 17, 18, 19, 20). In embodiments, the polypeptide linker has a repeat of $(GGGS)_n$ (SEQ ID NO: 21), wherein n is an integer from 1 to 20 (e.g. 1, 2, 3, 4, 5, 6, 7, 8, 9, 10, 11, 12, 13, 14, 15, 16, 17, 18, 19, or 20).

In some embodiments, the linker has an amino acid sequence of KESGSVSSEQLAQFRSLD (SEQ ID NO: 22). In some embodiments, the linker has an amino acid sequence of EGKSSGSGSESKST (SEQ ID NO: 23). In some embodiments, the linker only comprises glycine.

In some embodiments, the peptide linker comprises a protease cleavage site. In some embodiments, the protease cleavage site is a furin cleavage site.

In some aspects, the polypeptide linker is a poly-$(Gly)_n$ linker, wherein n is 1-30, for example, 1, 2, 3, 4, 5, 6, 7, 8, 9, 10, 15, 16, 17, 18, 19, 20, 21, 22, 23, 24, 25, 26, 27, 28, 29, or 30 (SEQ ID NO: 48). In other embodiments, the linker is selected from the group consisting of: dipeptides, tripeptides, and quadripeptides. In embodiments, the linker is a dipeptide selected from the group consisting of alanine-serine (AS), leucine-glutamic acid (LE), and serine-arginine (SR).

In some embodiments, the linker is selected from GKSSGSGSESKS (SEQ ID NO: 157), GST-SGSGKSSEGKG (SEQ ID NO; 158), GST-SGSGKSSEGSGSTKG (SEQ ID NO: 159), GST-SGSGKPGSGEGSTKG (SEQ ID NO: 160), EGKSSGSGSESKEF (SEQ ID NO: 161), SRSSG (SEQ ID NO: 162), and SGSSC (SEQ ID NO: 163).

In some embodiments, the linker is a self-cleaving peptide. In some embodiments, the self-cleaving peptide is a 2A peptide. 2A peptides are a class of 18-22 amino acid long peptides that induce ribosomal skipping during translation of a protein in a cell. In some embodiments, the 2A peptide is a T2A peptide having an amino acid sequence of EGRGSLLTCGDVEENPGP (SEQ ID NO; 164), a P2A peptide having an amino acid sequence of ATNFSLLKQAGDVEENPGP (SEQ ID NO: 165), an E2A peptide having an amino acid sequence of QCTNYALLKLAGDVESNPGP (SEQ ID NO: 166), or an F2A peptide having an amino acid sequence of VKQTLNFDLLKLAGDVESNPGP (SEQ ID NO: 167). In some embodiments, the 2A peptide has at least 80%, at least 85%, at least 90%, at least 95%, or at least 98% identity to any one of SEQ ID NOs. 164-167. In some embodiments, the 2A peptide further comprises GSG (SEQ ID NO: 168) on its N-terminus.

In some embodiments, the linker is a chemical linker. In some embodiments, the chemical linker is selected from the group consisting of a carbohydrate linker, a lipid linker, a fatty acid linker, and a polyether linker.

In some embodiments, the linker is a direct covalent linkage between the support and an AAV-binding polypeptide. In some embodiments, the linker is a direct covalent linkage between an amino acid residue of the AAV-binding polypeptide with an amino acid residue of the polypeptide with phase behavior. In some embodiments, a fusion protein comprises the polypeptide with phase behavior and AAV-binding polypeptide. In some embodiments, the fusion protein further comprises one or more linkers as described herein. In some embodiments, a fusion protein comprises, from N-terminus to C-terminus, a polypeptide with phase behavior, a linker, and an AAV-binding polypeptide. In some embodiments, a fusion protein comprises, from N-terminus to C-terminus, an AAV-binding polypeptide, a linker, and a polypeptide with phase behavior.

In some embodiments, the AAV-binding polypeptide comprises one or more polycystic kidney domains (PKDs) wherein the PKDs are individually selected from PKD1, PKD2, PKD3, PKD4, and PKD5. In some embodiments, a linker separates two or more PKDs. In some embodiments, an AAV-binding polypeptide comprises, from N-terminus to C-terminus, a first PKD domain, a linker, and a second PKD domain. In some embodiments, an AAV-binding polypeptide comprises, from N-terminus to C-terminus, a first PKD domain, a linker, a second PKD domain, a linker, and at least one additional PKD domain.

In some embodiments, the linker comprises a fragment of an AAVR. In some embodiments, the linker is between 1 and 1200 amino acids in length. In some embodiments, the linker comprises 1, 2, 3, 4, 5, 6, 7, 8, 9, 10, 20, 30, 40, 50, 60, 70, 80, 90, 100, 125, 150, 175, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1225, or 1250 amino acids. In some embodiments, the linker has an amino acid sequence selected from any one of SEQ ID NOS: 24-27.

Methods for Purifying AAV

In some embodiments, the present disclosure provides methods for purifying an AAV particle using the disclosed purification matrices.

In some embodiments, the purification matrix comprises (i) a polypeptide with phase behavior comprising an amino acid sequence of (GVGVPGLGVPGVGV PGLGVP GVGVP)$_m$ (SEQ ID NO: 12), wherein m is 16, and (ii) an AAV binding polypeptide comprising an amino acid sequence of SEQ ID NO: 29. In some embodiments, the purification matrix comprises (i) a polypeptide with phase behavior comprising an amino acid sequence of (GVGVPGLGVPGVGVPGLGVPGVGVP)$_m$ (SEQ ID NO: 12), wherein m is 16, and (ii) an AAV binding polypeptide comprising an amino acid sequence of SEQ ID NO: 52. In some embodiments, the purification matrix comprises (i) a polypeptide with phase behavior comprising an amino acid sequence of (GVGVPGLGVPGVGVPGLGVPGVGVP)$_m$ (SEQ ID NO: 12), wherein m is 16, and (ii) an AAV binding polypeptide comprising an amino acid sequence of SEQ ID NO: 64.

In some embodiments, the purification matrix comprises (i) a polypeptide with phase behavior comprising an amino acid sequence of (GVGVPGLGVPG VGVPGLGVPGVGVP)$_m$ (SEQ ID NO: 12), wherein m is 16, and (ii) an AAV binding polypeptide comprising an amino acid sequence of SEQ ID NO: 169. In some embodiments, the purification matrix comprises (i) a polypeptide with phase behavior comprising an amino acid sequence of SEQ ID NO: 170, and (ii) an AAV binding polypeptide comprising an amino acid sequence of SEQ ID NO: 169. In some embodiments, the purification matrix comprises an amino acid sequence of SEQ ID NO: 171, wherein the polypeptide with phase behavior comprises an amino acid sequence of SEQ ID NO: 170 and the AAV binding polypeptide comprises an amino acid sequence of SEQ ID NO: 169.

In some embodiments, the purification matrix comprises (i) a polypeptide with phase behavior comprising an amino acid sequence of SEQ ID NO: 88 and (ii) an AAV binding polypeptide comprising an amino acid sequence of SEQ ID NO: 29. In some embodiments, the purification matrix comprises (i) a polypeptide with phase behavior comprising an amino acid sequence of SEQ ID NO: 88, and (ii) an AAV binding polypeptide comprising an amino acid sequence of SEQ ID NO: 52. In some embodiments, the purification matrix comprises (i) a polypeptide with phase behavior comprising an amino acid sequence of SEQ ID NO: 88, and (ii) an AAV binding polypeptide comprising an amino acid sequence of SEQ ID NO: 64.

In some embodiments, the purification matrix comprises (i) a polypeptide with phase behavior comprising an amino acid sequence of (GVGVPGLGVPGVG VPGLGVPGVGVP)$_m$ (SEQ ID NO: 12), wherein m is 16, and (ii) an AAV binding polypeptide comprising an amino acid sequence of SEQ ID NO: 29. In some embodiments, the purification matrix comprises (i) a polypeptide with phase behavior comprising an amino acid sequence of (GVGVPGLGVPGVGVPGLGVPGVGVP)$_m$ (SEQ ID NO: 12), wherein m is 16, and (ii) an AAV binding polypeptide comprising an amino acid sequence of SEQ ID NO: 29, (iii) optionally up to about 10 additional amino acids at the N-terminus and/or C-terminus of the polypeptide with phase behavior and/or the AAV binding polypeptide, (iv) optionally a C-terminal glycine, and (v) optionally an N-terminal methionine.

In some embodiments, the purification matrix comprises (i) a polypeptide with phase behavior comprising an amino acid sequence of (GVGVPGLGVPGVG VPGLGVPGVGVP)$_m$ (SEQ ID NO: 12), wherein m is 16, and (ii) an AAV binding polypeptide comprising an amino acid sequence of SEQ ID NO: 52. In some embodiments, the purification matrix comprises (i) a polypeptide with phase behavior comprising an amino acid sequence of (GVGVPGLGVPGVGVPGLGVPGVGVP)$_m$ (SEQ ID NO: 12), wherein m is 16, and (ii) an AAV binding polypeptide comprising an amino acid sequence of SEQ ID NO: 52, (iii) an optional N-terminal methionine, (iv) an optional C-terminal glycine, and (v) optionally up to about 10 additional amino acids at the N-terminus and/or C-terminus of the polypeptide with phase behavior and/or the AAV binding polypeptide.

In some embodiments, the purification matrix comprises (i) a polypeptide with phase behavior comprising an amino acid sequence of (GVGVPGLGVPGV GVPGLGVPGVGVP)$_m$ (SEQ ID NO: 12), wherein m is 16, and (ii) an AAV binding polypeptide comprising an amino acid sequence of SEQ ID NO: 64. In some embodiments, the purification matrix comprises (i) a polypeptide with phase behavior comprising an amino acid sequence of (GVGVPGLGVPGVGVPGLGVPGVGVP)$_m$ (SEQ ID NO: 12), wherein m is 16, (ii) an AAV binding polypeptide comprising an amino acid sequence of SEQ ID NO: 64, (iii)

an optional N-terminal methionine, (iv) an optional C-terminal glycine, and (v) optionally up to about 10 additional amino acids at the N-terminus and/or C-terminus.

In some embodiments, the purification matrix comprises a polypeptide with phase behavior comprising an amino acid sequence of SEQ ID NO: 88.

In some embodiments, the purification matrix comprises an AAV binding polypeptide comprising an amino acid sequence of any one of SEQ ID NOS: 29, 52, or 64.

In some embodiments, the purification matrix comprises an AAV binding polypeptide comprising the amino acid sequence of SEQ ID NO: 64.

In some embodiments, the purification matrix has an amino acid sequence of SEQ ID NO: 87. In some embodiments, the purification matrix has an amino acid sequence of SEQ ID NO: 171. In some embodiments, the purification matrix has an amino acid sequence of any one of SEQ ID Nos: 171-174 or 87.

In some embodiments, the methods allow for separation of AAV particles from one or more impurities (also called contaminants herein). In some embodiments, the impurities are any chemical or biologic that is not desired in an AAV composition. In some embodiments, the impurities are viruses, proteins, nucleic acids, lipopolysaccharides, lipids, mycotoxins, carbohydrates, and/or cells. In some embodiments, the cells include bacterial cells, animal cells, and human cells. In some embodiments, the cell is selected from the group consisting of a bacterial cell, yeast cell, or an animal cell such as a mammalian cell. In some embodiments, the cell is a chicken cell, a mouse cell, a guinea pig cell, a rat cell, a rabbit cell, a goat cell, a horse cell, a sheep cell, a dog cell, a cat cell, or a cow cell. In some embodiments, the cell is a human cell.

In some embodiments, the disclosure provides methods for purifying a wildtype or mutant AAV selected from AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, and any other AAV now known or later discovered.

In some embodiments, the present disclosure provides a method for purifying AAV particles comprising contacting the AAV particles with a purification matrix comprising an AAV-binding polypeptide and a support, wherein the AAV-binding polypeptide is coupled to the support.

In some embodiments, the present disclosure provides a method for purifying AAV particles comprising contacting the AAV particles with a purification matrix comprising an AAV-binding polypeptide and a polypeptide with phase behavior, wherein the AAV-binding polypeptide is coupled to the polypeptide with phase behavior.

In some embodiments, a method of purifying an AAV particle comprises contacting the AAV particle with a purification matrix, wherein the purification matrix comprises (i) an AAV-binding polypeptide and (ii) a polypeptide with phase behavior; wherein the AAV particle binds to the purification matrix to form a complex; wherein the size of the complex is increased by a first environmental factor; wherein the complex is separated from at least one contaminant on the basis of size; and wherein the AAV particle is separated from the purification matrix by a second environmental factor.

In some embodiments, a method of purifying an AAV particle comprises contacting the AAV particle with a purification matrix, wherein the purification matrix comprises (i) an AAV-binding polypeptide and (ii) a polypeptide with phase behavior; wherein the AAV particle binds to the matrix to form a complex; wherein the size of the complex is increased; wherein the complex is separated from at least one contaminant on the basis of size; and wherein the AAV particle is separated from the matrix by an environmental factor.

In some embodiments, the methods described herein comprise the formation of a complex between an AAV particle and a purification matrix. In some embodiments, the AAV particle binds reversibly to a purification matrix. In some embodiments, the AAV particle binds to a purification matrix described herein through non-covalent interactions.

In some embodiments, a complex is formed between a purification matrix described herein and a wildtype or mutant AAV particle of a serotype selected from AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, and any other AAV serotype now known or later discovered.

In some embodiments, a complex is formed between a purification matrix and an AAV particle having a wildtype AAV capsid protein. In some embodiments, the complex is formed between a purification matrix and an AAV particle having a mutant AAV capsid protein. In some embodiments, the complex is formed between a purification matrix and a human AAV particle. In some embodiments, the complex is formed between a purification matrix and a primate AAV particle. In some embodiments, the complex is formed between a purification matrix and a bovine AAV particle. In some embodiments, the complex is formed between a purification matrix and an avian AAV particle. In some embodiments, the complex is formed between a purification matrix and an orangutan AAV particle. In some embodiments, the complex is formed between a purification matrix and a monkey AAV particle. In some embodiments, the complex is formed between a purification matrix and a mouse AAV particle.

In some embodiments, an environmental factor is used to increase the size of the AAV-purification matrix complex. As used herein, the phrase "increase in size" may refer to an increase in the diameter of the complex or an increase in the mass of the complex. In some embodiments, the increase in size is an increase in the molar mass of the complex. In some embodiments, the increase in size is an increase in the hydrodynamic radius of the complex.

In some embodiments, the size of the complexes described herein increase after an environmental factor is applied. In some embodiments, the size of a complex formed between the purification matrix and biologic, contaminant, and/or other molecule increases. In some embodiments, the size of the initial complex increases as a result of aggregation of multiple complexes. In some embodiments, multiple complexes aggregate due to self-assembly of purification matrices. In some embodiments, multiple complexes aggregate due to the application of an environmental factor. In some embodiments, the size increase is stabilized by non-covalent interactions between multiple protein-based purification matrix molecules. In some embodiments, the size increase is stabilized by non-covalent interactions between the polypeptides with phase behavior. In some embodiments, the non-covalent interactions are dipole-dipole forces, van der Waals forces, London Dispersion forces, hydrogen bonding, hydrophobic interactions, and/or electrostatic interactions.

In some embodiments, the methods of the disclosure provide for the formation of multiple complexes in a mixture. In some embodiments, the size of all of complexes increase. In some embodiments, the size of some complexes increases, and the size of the other complexes remains constant. In some embodiments, the size of one complex increases, and the size of the other complex remains constant.

In some embodiments, the size of the complex increases by at least about 2-fold, at least about 5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, or more. In some embodiments, the size of the initial complex increases by at least about 2-fold. In some embodiments, the size of the initial complex increases by at least about 5-fold. In some embodiments, the size of the initial complex increases by at least about 10-fold. In some embodiments, the size of the initial complex increases by at least about 25-fold.

In some embodiments, the increase in size of the complex can be observed visually with an unaided eye. For example, the increase in size of the complex may cause a composition comprising the complex to change color, clarity, viscosity, and/or may cause the complex to change solubility (e.g., to precipitate from solution), wherein such change is observable by a human without the use of any special equipment.

In some embodiments, a person of skill in the art may measure the increase in the size of the complex according to known methods in the art. In some embodiments, the increase in the size of the complex can be measured utilizing a technique selected from the group consisting of x-ray scattering, small angle x-ray scattering, wide angle x-ray scattering, dynamic light scattering, analytical ultracentrifugation, size exclusion chromatography, and photon correlation spectroscopy.

In some embodiments, the environmental factor is the first environmental factor added to the composition comprising the AAV particle and the purification matrix. Examples of environmental factors are provided throughout this disclosure.

In some embodiments, the AAV-purification matrix complex is separated from one or more impurities by washing the AAV-purification matrix complex. In some embodiments, washing the AAV-purification matrix does not interfere with binding of the AAV particle to the purification matrix. In some embodiments, the AAV-purification matrix complex is washed with a buffer. Non-limiting examples of buffers include sodium acetate, saline, glycine-HCL, cacodylate buffer, Tris-HCl, 4-(2-hydroxyethyl)-1-piperazineethanesulfonic acid (HEPES), 2-(N-morpholino)ethanesulfonic acid (MES), 3-(N-morpholino)propanesulfonic acid (MOPS), citrate, phosphate buffer, tris(hydroxymethyl)methylamino]propanesulfonic acid (TAPS), and tris(hydroxymethyl)aminomethane (Tris). In some embodiments, the buffer comprises one or more of arginine, histidine, urea, pluronic acid, and triton-x-100. In some embodiments, the AAV-purification matrix complex is washed with a solvent.

Non-limiting examples of solvents include acetone, acetonitrile, dimethylformamide, water, ethanol, toluene, methyl acetate, and ethyl acetate.

In some embodiments, the AAV-purification matrix complex is separated from at least one impurity on the basis of size. In some embodiments, the AAV-purification matrix complex is separated from at least one impurity on the basis of diameter. In some embodiments, the AAV-purification matrix is separated from at least one impurity on the basis of radius. In some embodiments, the AAV-purification matrix is separated from at least one impurity on the basis of mass. In some embodiments, the AAV-purification matrix is separated from at least one impurity on the basis of molar mass. In some embodiments, the AAV-purification matrix is separated from at least one impurity on the basis of size by using a technique selected from the group consisting of centrifugation, tangential flow filtration, analytical ultracentrifugation, membrane chromatography, high performance liquid chromatography, size exclusion chromatography, normal flow filtration, acoustic wave separation, centrifugation, counterflow centrifugation, and fast protein liquid chromatography.

In some embodiments, the AAV-purification matrix complex is separated from at least one impurity on the basis of size using centrifugation. In some embodiments, between about 100 relative centrifugal force (RCF) and about 16,000 RCF, for example, about 500 to about 16,000 RCF, about 1,000 RCF to 16,000 RCF, are applied to separate the AAV-purification matrix complex from at least one impurity. In some embodiments, at least 500 relative centrifugal force (RCF) are applied to separate the AAV-purification matrix complex from at least one impurity, for example, at least about 500 RCF, at least about 600 RCF, at least about 700 RCF, at least about 800 RCF, at least about 900 RCF, at least about 1000 RCF, at least about 2000 RCF, at least about 3000 RCF, at least about 3500 RCF, at least about 4000 RCF, at least about 5000 RCF, at least about 6000 RCF, at least about 7000 RCF, at least about 8000 RCF, at least about 9000 RCF, at least about 10,000 RCF, at least about 11,000 RCF, at least about 12,000 RCF, at least about 13,000 RCF, at least about 14,000 RCF, at least about 15,000 RCF, at least about 16,000 RCF, at least about 17,000 RCF, at least about 18,000 RCF, at least about 19,000 RCF, or at least about 20,000 RCF.

In some embodiments, the AAV-purification matrix is separated from at least one impurity on the basis of size by using TFF. In some embodiments, TFF may be used to separate the AAV-purification matrix from at least one impurity on the basis of size, a process also referred to herein as "diafiltration." Diafiltration comprises both washing and elution steps. Washing removes impurities contained in the composition comprising the AAV-purification matrix. Elution separates purified AAV particles from the purification matrix. In some embodiments, the AAV-purification matrix is concentrated using TFF. In some embodiments, TFF may be used to increase the concentration of an AAV-purification matrix within a composition, a process also referred to herein as "concentration."

Tangential flow filtration employs both microfiltration and ultrafiltration membranes to separate and/or concentrate molecules. Microfiltration membranes typically have pore sizes between 0.1 μm and 10 μm. Ultrafiltration membranes typically have smaller pore sizes than microfiltration membranes with pore sizes between 0.001 μm and 0.1 μm. In some embodiments, a membrane with a pore size between about 0.001 μm and about 10 μm is utilized in the methods of the disclosure. In some embodiments, the membrane has a pore size of about 0.001 μm, about 0.01 μm, about 0.05 μm, about 0.1 μm, about 0.2 μm, about 0.3 μm, about 0.4 μm, about 0.5 μm, about 0.6 μm, about 0.7 μm, about 0.8 μm, about 0.9 μm, about 1.0 μm, about 2 μm, about 3 μm, about 4 μm, about 5 μm, about 6 μm, about 7 μm, about 8 μm, about 9 μm, or about 10 μm, including all values and ranges in between thereof. In some embodiments, the membrane has a pore size of about 0.1 μm. In some embodiments, the membrane has a pore size of about 0.2 μm.

In some embodiments, the membrane is made of hydrophilized poly(vinylildene difluoride) (PVDF), polyethersulfone (PES), cellulose phosphate, diethylaminoethyl cellulose, polysufone, regenerated cellulose, nylon, cellulose nitrate, cellulose acetate, pegylated PES, and sulfonated PES.

In TFF, a membrane is placed tangentially to the flow of a fluid mixture to cause the fluid mixture to flow tangentially over a first side of the membrane. At the same time, a fluid media is placed in contact with a second surface of the membrane. A transmembrane pressure is the force that drives fluid through the membrane, carrying along permeable molecules.

In some embodiments, separation of the complex of AAV and purification matrix from the one or more contaminants or impurities on the basis of size is performed using TFF with a transmembrane pressure of between about 0.1 bar to about 3 bar. In some embodiments, the transmembrane pressure is about 0.1 bar, about 0.2 bar, about 0.3 bar, about 0.4 bar, about 0.5 bar, about 0.6 bar, about 0.7 bar, about 0.8 bar, about 0.9 bar, about 1.0 bar, about 1.1 bar, about 1.2 bar, about 1.3 bar, about 1.4 bar, about 1.5 bar, about 1.6 bar, about 1.7 bar, about 1.8 bar, about 1.9 bar, about 2.0 bar, about 2.1 bar, about 2.2 bar, about 2.3 bar, about 2.4 bar, about 2.5 bar, about 2.6 bar, about 2.7 bar, about 2.8 bar, about 2.9 bar, or about 3.0 bar, including all values and ranges in between thereof. In some embodiments, the transmembrane pressure is about 1.5 bar.

In some embodiments, the cross flow rate is tuned to improve the separation of the complex of AAV particle and purification matrix described herein from the one or more contaminants. The cross flow rate is the rate of solution flow through the feed channel and across the membrane. It provides the force that sweeps away molecules that can restrict filtrate flow. In some embodiments, the cross flow rate is between about 500 L/m²/h and about 2000 L/m²/h. In some embodiments, the cross flow rate is between about 500 L/m²/h, about 600 L/m²/h, about 700 L/m²/h, about 800 L/m²/h, about 900 L/m²/h, about 1000 L/h, about 1100 L/m²/h, about 1200 L/m²/h, about 1300 L/m²/h, about 1400 L/m²/h, about 1500 Lm/h, about 1600 L/m²/h, about 1700 L/m²/h, about 1800 L/m²/h, about 1900 L/m²/h, or about 2000 L/m²/h, including all values and ranges in between thereof. In some embodiments, the cross flow rate is about 960 Lm/h. In some embodiments, TFF separation occurs by using a membrane that retains the complex comprising the purification matrix and the AAV particle while passing the contaminant.

In some embodiments, the AAV particle is eluted from the AAV-purification matrix complex by changing the pH of the composition comprising the AAV-purification matrix complex. In some embodiments, the pH is increased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units. In some embodiments, the pH is decreased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units. In some embodiments, the AAV particle is eluted from the AAV-purification matrix complex at a pH of about 2. In some embodiments, the AAV particle is eluted from the AAV-purification matrix complex at a pH of about 3 allows.

In some embodiments, the AAV particle is eluted from the AAV-purification matrix complex by changing the temperature of the composition comprising the AAV-purification matrix complex. In some embodiments, the temperature is increased 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C. In some embodiments, the temperature is decreased about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C.

In some embodiments, the AAV particle is eluted from the AAV-purification matrix complex by changing the ionic strength of the composition comprising the AAV-purification matrix complex. In some embodiments, the change in ionic strength is brought about by increasing the concentration of salt. In some embodiments, the change in ionic strength is brought about by decreasing the concentration of salt. Non-limiting examples of salts include sodium chloride, potassium chloride, ammonium chloride, sodium acetate, sodium citrate, glycine, arginine, copper sulfate, sodium iodide, ammonium sulfate, and sodium sulfate. In some embodiments, a dialysis is used to change the concentration of salt in the composition comprising the protein-based purification matrix and biologic, contaminant, and/or molecule.

In some embodiments, the AAV particle is eluted from the AAV-purification matrix complex by addition of a reducing agent to the composition comprising the AAV-purification matrix complex. In some embodiments, the one or more reducing agents is selected from the group consisting of dithiothreitol (DTT), 2-mercaptoethanol (BME), Tris (2-carboxyethyl) phosphine (TCEP), hydrazine, boron hydrides, amine boranes, lower alkyl substituted amine boranes, triethanolamine, and N,N,N',N'-tetramethylethylenediamine (TEMED).

In some embodiments, an environmental factor is used to elute the AAV particle from the AAV-purification matrix complex. In some embodiments, the environmental factor is the first environmental factor added to the composition comprising the AAV particle and the AAV-purification matrix complex. In some embodiments, the environmental factor is the second environmental factor added to the composition comprising the AAV particle and the AAV-purification matrix complex. Non-limiting examples of environmental factors are provided throughout this disclosure.

In some embodiments, the method of purifying AAV particles using a purification matrix described herein is completed in about 30 minutes to about 24 hours. In some embodiments, the methods described herein are completed in about 30 minutes to about 24 hours. In some embodiments, the methods are completed in about 30 minutes, about 1 hr, about 2 hr, about 3 hr, about 4 hr, about 5 hr, about 6 hr, about 7 hr, about 8 hr, about 9 hr, about 10 hr, about 11 hr, about 12 hr, about 13 hr, about 14 hr, about 15 hr, about 16 hr, about 17 hr, about 18 hr, about 19 hr, about 20 hr, about 21 hr, about 22 hr, about 23 hr, or about 24 hr. In some embodiments, the method of purifying AAV particles using a purification matrix described herein is completed in about 2 hours to about 10 hours.

In some embodiments, the purification yield of the AAV particles is at least 70%, at least 80%, at least 90%, at least 95%, at least 96%, at least 97%, at least 98%, or at least 99%.

In some embodiments, the AAV particles are purified to at least 70%, at least 80%, at least 90%, at least 95%, at least 96%, at least 97%, at least 98%, or at least 99% purity.

In some embodiments, the methods described herein enable the purification of at least 0.1 kg, at least about 0.2 kg, at least about 0.3 kg, at least about 0.4 kg, at least about 0.5 kg, at least about 0.6 kg, at least about 0.7 kg, at least about 0.8 kg, at least about 0.9 kg, at least about 1 kg, at least about 2 kg, at least about 3 kg, at least about 4 kg, at least about 5 kg, at least about 6 kg, at least about 7 kg, at least about 8 kg, at least about 9 kg, at least about 10 kg, or more of AAV per day, including all values and ranges in between thereof.

In some embodiments, the AAV particles retain their biological activity and/or structure. In some embodiments, the purified AAV particles have enhanced biological activity.

In some embodiments, the purified AAV particles retain about 95% of their infectivity after purification. In some embodiments, the purified AAV particles retain about 96% of their infectivity after purification. In some embodiments, the purified AAV particles retain about 97% of their infectivity after purification. In some embodiments, the purified AAV particles retain about 98% of their infectivity after purification. In some embodiments, the purified AAV particles retain about 99% of their infectivity after purification. In some embodiments, the purified AAV particles retain about 100%/6 its infectivity after purification.

In some embodiments, a composition comprising AAV particles purified using the matrix disclosed herein is enriched for AAV particles that are "full." Full AAV particles include the desired genomic material (e.g., an AAV genome or transfer cassette), encapsidated within the AAV capsid. Empty AAV particles lack the desired genomic material.

There are several techniques for determining the relative amount of full and empty particles in a sample. For example, the total number of AAV particles present in a sample eluted from the purification matrix of the disclosure may be determined using an ELISA. In some embodiments, the number of viral genomes present in a sample eluted from the purification matrix of the disclosure may be determined using quantitative polymerase chain reaction (qPCR). In some embodiments, qPCR primers target the inverted terminal repeat (ITR) sequence. qPCR utilizing primers that target the ITR sequence is referred to herein as "TTR qPCR". The ratio of the number of viral genomes to the total number of AAV particles provides an approximation of the ratio of full particles to total particles. In some embodiments, a qPCR:ELISA value (e.g. the number of viral genomes present in the sample: the total number of AAV particles present in the sample) is used to approximate the ratio of full particles relative to total particles.

In some embodiments, the qPCR:ELISA value increases after purification with a purification matrix of the disclosure. In some embodiments, after purification with a purification matrix of the disclosure, the qPCR:ELISA value of the sample increases by at least about 25%, for example at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or at least about 100%, compared to the qPCR ELISA value of the sample before purification. In some embodiments, after purification with a purification matrix of the disclosure, the qPCR:ELISA value of the sample increases by at least about 50% compared to the qPCR: ELISA value of the sample before purification.

Methods for Stabilizing AAV Particles

The instant inventors have discovered that the purification matrices described herein may unexpectedly help stabilize AAV particles during production, purification, and/or storage thereof. As used herein with relation to an AAV particle, the term "stabilize" or "stabilizing" refers to the ability of a purification matrix to reduce degradation or aggregation of an AAV sample comprising a plurality of AAV particles, to prevent AAV particles from binding other proteins (e.g., a cellular AAV receptor), or to enhance synthesis by a producer cell.

Thus, in some embodiments, an AAV particle is contacted with a purification matrix during production, purification, or storage thereof. In some embodiments, a method of increasing yield of AAV particles during production thereof comprises culturing AAV-producing cells in the presence of a purification matrix. In some embodiments, a method of stabilizing AAV particles during production thereof comprises culturing AAV-producing cells in the presence of a purification matrix. In some embodiments, a method of stabilizing AAV particles during purification thereof comprises contacting the AAV particles with a purification matrix during purification thereof. In some embodiments, a method of stabilizing AAV particles during storage thereof comprises storing the AAV particles in the presence of a purification matrix. In some embodiments, a method of increasing the shelf-life of AAV particles comprises storing the AAV particles in the presence of a purification matrix.

For example, a purification matrix may be contacted with an AAV particle during production in culture. AAV particles are typically produced in production cell lines, such as HEK293 cells or Sf9 cells. In some embodiments, the production cell lines are transfected with one or more plasmids containing various genes required to produce AAV (e.g., a triple transfection protocol). In some embodiments, the production cell lines are infected with baculoviral constructs containing various genes required to produce AAV. Adding the purification matrix to the AAV production cells in culture (e.g., by adding it to the tissue culture media) may increase the yield and/or quality of AAV particles obtained during this process. In some embodiments, the purification matrix may be added to the culture at a concentration of about 1 μM to about 1 mM, for example, about 1 μM, about 2 μM, about 3 μM, about 4 μM, about 5 μM, about 6 μM, about 7 μM, about 8 μM, about 9 μM, about 10 μM, about 20 μM, about 30 μM, about 40 μM, about 50 μM, about 60 μM, about 70 μM, about 80 μM, about 90 μM, about 100 μM, about 150 μM, about 200 μM, about 250 μM, about 300 μM, about 350 μM, about 400 μM, about 450 μM, about 500 μM, about 550 μM, about 600 μM, about 650 μM, about 700 μM, about 750 μM, about 800 μM, about 850 μM, about 900 μM, about 950 μM, or about 1 mM, including all values and ranges in between. In some embodiments, the purification matrix is added to culture at a concentration of about 10 μM. In some embodiments, the purification matrix is added to culture at a concentration of about 100 μM. Without being bound by any theory, it is believed that the purification matrix can bind to and/or physically surround AAV particles as they are produced, thereby preventing them from binding other proteins, including cellular receptors for the AAV particle. Thus, an AAV produced by a cultured cell and secreted into culture medium, in the presence of purification matrix, would not be able to re-infect a producer cell. In some embodiments, adding a purification matrix to AAV production cell lines in culture may increase the yield of AAV particles. For example, adding a purification matrix to AAV production cell lines in culture may result in an increase in viral titer obtained by at least 2-fold, at least 3-fold, at least 4-fold, at least 5-fold, at least 6-fold, at least 7-fold, at least 8-fold, at least 9-fold, at least 10-fold, at least 50-fold, at least 100-fold, or more, compared to cells cultured without the purification matrix.

As another example, after a purified AAV sample is prepared (using the methods described herein, or other methods known in the art), a purification matrix may be added to the sample before storage (e.g., freezing). Without being bound by any theory, it is believed that the purification matrix can bind to and/or physically surround AAV particles, thus preventing them from aggregating with other AAV particles, and also helping to protect them from degradation, particularly during multiple freeze-thaw cycles. Aggregation of AAV particles may be observed visually by microscopy and/or by a technique selected from the group consisting of x-ray scattering, laser diffraction, analytical ultracentrifugation, dynamic light scattering, nanoparticle tracking analysis, resonant mass measurement, size exclusion chromatography, gel permeation chromatography, light obscuration, and combinations thereof. In some embodiments, the AAV particle may be frozen and stored in the presence of a purification matrix at temperatures between about −80° C. and about 40° C., for example, about −80° C., about −75° C., about −70° C., about −65° C., about −60° C., about −55° C., about −50° C., about −45° C., about −40° C., about −35° C., about −30° C., about −25° C., about −20° C., about −15° C., about −10° C., about −5° C., about 0° C., about 4° C., about 5° C., about 10° C., about 15° C., about 20° C., about 25° C., about 30° C., about 35° C., or about 40° C.

In some embodiments, when an AAV particle is stored in the presence of a purification matrix, the shelf life of the AAV particle is at least about 10% longer as compared to a sample stored in the absence of purification matrix. For example, in some embodiments, the shelf life is at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of a AAV stored in the absence of a purification matrix at about the same temperature.

In some embodiments, an AAV sample is stored at about −80° C. in the presence of a purification matrix. In some embodiments, an AAV sample is stored at about −20° C. in the presence of a purification matrix. In some embodiments, an AAV sample is stored at about 4° C. in the presence of a purification matrix. In some embodiments, when AAV is stored in the presence of a purification matrix at about −80° C., about −20° C., or about 4° C., the shelf life of AAV is at least about 10% longer than if it was stored in the absence of the purification matrix. For example, the shelf life of the AAV particle may be at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of AAV stored in the absence of a purification matrix at the same temperature. As used herein, increased shelf life may refer to an increase in the amount of time an AAV sample is stored and still retains substantially the same level of infectivity.

In some embodiments, use of the purification matrix to stabilize AAV particles during production, purification, and/or storage thereof may increase the yield of "full" AAV particles. Thus, in some embodiments, improved stabilization of AAV particles upon contact with a purification matrix may be measured by quantitating the number of full AAV particles as compared to empty particles. In some embodiments, use of a purification matrix during production, purification, and/or storage of an AAV sample may result in an increased qPCR: ELISA value, as compared to an AAV sample that is not produced, purified, and/or stored in the presence of a purification matrix.

Environmental Factors

In some embodiments, the methods of the disclosure provide one or more environmental factors to the compositions comprising a purification matrix and an AAV particle. In some embodiments, one or more environmental factors are applied to the compositions comprising a purification matrix and an AAV particle. Application of an environmental factor causes a change in the composition comprising the purification matrix and an AAV particle. In some embodiments, an environmental factor is used to increase the size of the AAV-purification matrix complex. In some embodiments, the environmental factor is used to remove one or more impurities from the composition comprising the AAV-purification matrix complex. In some embodiments, the environmental factor is used to elute one or more AAV particles from the purification-matrix complex. In some embodiments, the one or more environmental factors cause the size of the complex between the protein-based purification matrix and biologic, contaminant, and/or molecule to increase. In some embodiments, the one or more environmental factors cause a polypeptide with phase behavior to aggregate. In some embodiments, the one or more environmental factors enables an AAV particle to retain its native structure, function, and activity. In some embodiments, the one or more environmental factors enables an AAV particle to enhance its native structure, function, and activity.

In some embodiments, the environmental factor is a change in temperature. In some embodiments, the temperature is increased by about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C. In some embodiments, the temperature is decreased by about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C.

In some embodiments, the environmental factor is a change in pH. In some embodiments, the pH is increased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units.

In some embodiments, the pH is decreased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units.

In some embodiments, the environmental factor is change in ionic strength. In some embodiments, the change in ionic strength is brought about by increasing the concentration of salt. In some embodiments, the change in ionic strength is brought about by decreasing the concentration of salt. Non-limiting examples of salts include sodium chloride, potassium chloride, magnesium chloride, calcium chloride ammonium chloride, sodium acetate, sodium citrate, copper sulfate, sodium iodide, and sodium sulfate. In some embodiments, the salt has a concentration of between about 0.1 M and about 5 M, for example, about 0.1 M, about 0.2 M, about 0.3 M, about 0.4 M, about 0.5 M, about 0.6 M, about 0.7 M, about 0.8 M, about 0.9 M, about 1 M, about 1.1 M, about 1.2 M, about 1.3 M, about 1.4 M, about 1.5 M, about 1.6 M, about 1.7 M, about 1.8 M, about 1.9 M, about 2 M, about 2.1 M, about 2.2 M, about 2.3 M, about 2.4 M, about 2.5 M, about 2.6 M, about 2.7 M, about 2.8 M, about 2.9 M, about 3 M, about 3.1 M, about 3.2 M, about 3.3 M, about 3.4 M, about 3.5 M, about 3.6 M, about 3.7 M, about 3.8 M, about 3.9 M, about 4 M, about 4.1 M, about 4.2 M, about 4.3 M, about 4.4 M, about 4.5 M, about 4.6 M, about 4.7 M, about 4.8 M, about 4.9 M, or about 5 M. In some embodiments, the salt has a concentration of 0.6 M. In some embodiments, dialysis is used to change the concentration of salt in the composition comprising the protein-based purification matrix and biologic, contaminant, and/or molecule.

In some embodiments, the environmental factor is the addition of a cofactor. Non-limiting examples of cofactors include calcium, magnesium, cobalt, copper, zinc, iron, manganese, selenium, molybdenum, potassium, coenzyme A (CoA), a nucleoside triphosphate, and a vitamin (e.g., vitamin A, B, C, D, or F). In some embodiments, the cofactor is calcium. In some embodiments, the nucleoside triphosphate is adenosine triphosphate, uridine triphosphate, guanosine triphosphate, cytidine triphosphate, or thymidine triphosphate. In some embodiments, the vitamin is a fat-soluble. In some embodiments, the vitamin is water-soluble. Non-limiting examples of vitamins include vitamin A, vitamin B1 (thiamine), vitamin B2 (riboflavin), vitamin B3 (niacin or niacinamide), vitamin B5 (pantothenic acid), Vitamin B6 (pyridoxine, pyridoxal, or pyridoxamine, or pyridoxine hydrochloride), vitamin B7 (biotin), vitamin B9 (folic acid), vitamin B12, vitamin C, vitamin D, Vitamin E, vitamin K, K1, and K2, folic acid, and biotin.

In some embodiments, the environmental factor is a change in the concentration of the protein-based purification matrix. In some embodiments, the environmental factor is a change in the concentration of the biologic, contaminant, and/or molecule.

In some embodiments, the environmental factor is a change in pressure of the composition comprising the protein-based purification matrix and biologic, contaminant, and/or molecule. In some embodiments, a change in pressure can be effected by increasing or decreasing the volume of the composition.

In some embodiments, the environmental factor is the addition of one or more surfactants. In some embodiments, the one or more surfactants are free fatty acid salts, soaps, fatty acid sulfonates, such as sodium lauryl sulfate, ethoxylated compounds, such as ethoxylated propylene glycol, lecithin, polygluconates, quaternary ammonium salts, lignin sulfonates, 3-((3-cholamidopropyl) dimethylammonio)-1-propanesulfonate (CHAPS), sugars, including sucrose and glucose, Triton X-100, and NP-40. In some embodiments, the surfactant is anionic, nonionic, or amphoteric.

In some embodiments, the environmental factor is the addition of one or more molecular crowding agents. Non-limiting examples of molecular crowding agents include polyethylene glycol, dextran, and ficoll. PEGS may include PEG400, PEG1450, PEG3000, PEG8000, and PEG10000.

In some embodiments, the environmental factor is the addition of one or more oxidizing agents. Non-limiting examples of oxidizing agents include hydrogen peroxide, hydrophilically or hydrophobically activated hydrogen peroxide, preformed peracids, monopersulfate or hypochlorite.

In some embodiments, the environmental factor is the addition of one or more reducing agents. In some embodiments, the one or more reducing agents is selected from the group consisting of dithiothreitol (DTT), 2-mercaptoethanol (BME), Tris (2-carboxyethyl) phosphine (TCEP), hydrazine, boron hydrides, amine boranes, lower alkyl substituted amine boranes, triethanolamine, and N,N,N',N'-tetramethylethylenediamine (TEMED). In some embodiments, the environmental factor is the addition of one or more denaturing agents. Non-limiting examples of denaturing agents include urea, guanidine hydrochloride, guanidine, sodium salicylate, dimethyl sulfoxide, and propylene glycol.

In some embodiments, the environmental factor is the addition of one or more enzymes. Non-limiting examples of enzymes include proteases, kinases, phosphatases, synthetases, transferases, nucleases such as restriction endonucleases, lyases, isomerases, dehydrogenases, decarboxylases, and lipases.

In some embodiments, the environmental factor is the application of electromagnetic waves. In some embodiments, the environmental factor is the application of light. In some embodiments, the electromagnetic waves have a wavelength between about 0.0001 nm and about 100 m. In some embodiments, the electromagnetic waves are selected from the group consisting of gamma rays, x-rays, ultraviolet, visible, infrared, and radio waves. In some embodiments, the electromagnetic waves are gamma rays. In some embodiments, the gamma rays have a wavelength between about 0.0001 nm and about 0.01 nm, e.g. 0.0001 nm, 0.0005 nm, 0.001 nm, 0.002 nm, 0.003 nm, 0.004 nm, 0.005 nm, 0.006 nm, 0.007 nm, 0.008 nm, 0.009 nm, and 0.01 nm. In some embodiments, the x-rays have a wavelength between about 0.01 nm and about 10 nm, e.g. about 0.01 nm, 0.02 nm, 0.03 nm, 0.04 nm, 0.05 nm, 0.06 nm, 0.07 nm, 0.08 nm, 0.09 nm, 0.10 nm, 0.2 nm, 0.3 nm, 0.4 nm, 0.5 nm, 0.6 nm, 0.7 nm, 0.8 nm, 0.9 nm, 1 nm, 2 nm, 3 nm, 4 nm, 5 nm, 6 nm, 7 nm, 8 nm, 9 nm, or about 10 nm. In some embodiments, the ultraviolet radiation has a wavelength between about 10 nm about 400 nm, e.g. about 10 nm, about 20 nm, about 30 nm, about 40 nm, about 50 nm, about 60 nm, about 70 nm, about 80 nm, about 90 nm, about 100 nm, about 150 nm, about 200 nm, about 250 nm, about 280 nm, about 300 nm, about 350 nm, or about 400 nm. In some embodiments, the visible waves have a wavelength of between about 400 nm and about 800 nm, e.g. about 400 nm, about 450 nm, about 500 nm, about 550 nm, about 600 nm, about 650 nm, about 700 nm, about 750 nm, or about 800 nm. In some embodiments, the infrared radiation has a wavelength of between about 800 nm and about 0.1 cm, e.g. about 800 nm, about 1 μm, about 2 μm, about 3 μm, about 4 μm, about 5 μm, about 6 μm, about 7 μm, about 8 μm, about 9 μm, about 10 μm, about 20 μm, about 30 μm, about 40 μm, about 50 μm, about 60 μm, about 70 μm, about 80 μm, about 90 μm, about 100 μm, about 200 μm, about 300 μm, about 400 μm, about 500 μm, about 600 μm, about 700 μm, about 800 μm, about 900 μm, or about 0.1 cm. In some embodiments, the radio waves have a wavelength of between about 0.1 cm and 100 m, e.g. about 0.1 cm, about 1 cm, about 10 cm, about 100 cm, about 1000 cm, about 2000 cm, about 3000 cm, about 4000 cm, about 5000 cm, about 6000 cm, about 7000 cm, about 8000 cm, about 9000 cm, or about 100 m.

In some embodiments, the environmental factor is the application of acoustic waves. In some embodiments, the acoustic waves have a frequency between about 1 Hz and 2000 kHz. In some embodiments, the acoustic waves have a frequency of about 1 Hz, about 5 Hz, about 10 Hz, about 20 Hz, about 30 Hz, about 40 Hz, about 50 Hz, about 60 Hz, about 70 Hz, about 80 Hz, about 90 Hz, about 100 Hz, about 200 Hz, about 300 Hz, about 400 Hz, about 500 Hz, about 600 Hz, about 700 Hz, about 800 Hz, about 900 Hz, about 1 kHz, about 100 kHz, about 200 kHz, about 300 kHz, about 400 kHz, about 500 kHz, about 600 kHz, about 700 kHz, about 800 kHz, about 900 kHz, about 1000 kHz, about 1100 kHz, about 1200 kHz, about 1300 kHz, about 1400 kHz, about 1500 kHz, about 1600 kHz, about 1700 kHz, about 1800 kHz, about 1900 kHz, or about 2000 kHz.

EXAMPLES

Example 1. Development of AAV-Binding Polypeptides

Site-directed mutagenesis of the wild-type AAVR ectodomain is performed. More specifically, AAV-binding polypeptides comprising an amino acid sequence are selected from any one of SEQ ID NOS: 3347, are subjected to site-directed mutagenesis of one or more amino acid residues using standard cloning techniques. The affinity of the AAV binding polypeptides is characterized. AAV-binding polypeptides that have a binding affinity for AAV of at least 50 nM or higher are selected. The ability of various environmental factors, including change in pH and addition of salt, to disrupt the AAV binding polypeptide's binding to AAV is characterized.

Example 2. Use of a Purification Matrix Comprising an AAV-Binding Polypeptide and a Polypeptide with Phase Behavior to Purify AAV Purification matrices comprising the AAV-binding polypeptides of Example 1 are generated and characterized. More specifically, fusion proteins comprising (i) the AAV-binding polypeptides of Example 1 and (ii) a polypeptide with phase behavior (e.g., an ELP) are expressed in *Escherichia coli* according to standard protocols. Isothermal titration calorimetry is utilized to characterize the affinity of the fusion protein for AAV particles. The transition temperature of the fusion protein is determined using UV-Vis spectrophotometry. The fusion proteins are then covalently coupled to a support during a linker, using standard techniques, to produce the purification matrix. The support is a bead, such as a magnetic or porous bead.

The purification matrix is then incubated with different purified AAV samples separately, including AAV1, AAV2, AAV3B, AAV5, AAV6, AAV8, and AAV9. The purification matrix forms a complex with the various AAV particles.

Various molar ratios of purification matrix to AAV particles are tested to determine an optimal ratio for purification (i.e., for complete capture of the AAV particles). An environmental factor (e.g., addition of salt such as sodium chloride or ammonium sulfate) is applied to the composition containing the purification matrix and the biologic to cause the protein-based purification matrix increase in size.

Both tangential flow filtration and centrifugation are utilized to separate the AAV particles from the protein-based purification matrix. Although both centrifugation and tangential flow filtration enable separation of the biologic from the protein-based purification matrix, tangential flow filtration is preferred because it enables the rapid purification of thousands of liters of sample volume without the requirement for specialized centrifuges.

TFF is performed using standard conditions—for example, a 1.5 bar transmembrane pressure and a 960 L/m²/h cross flow rate. Standard TFF membranes are used, such as a 0.1 μm hydrophilized poly(vinylidene difluoride) (PVDF) membrane.

The pH is adjusted (for example to an acidic pH such as 4.5) to separate (i.e. elute) the purification matrix from the AAV. The purity of the AAV is characterized by size exclusion chromatography. The protein-based purification matrix is then re-used for an additional round of purification.

Example 3. Utilization of Purification Matrices Comprising AAV-Binding Polypeptides and a Support to Purify AAV from a Cell Lysate AAVs are produced in a producer cell line (e.g., HEK293) according to standard protocols. The cells are lysed, and centrifuged to remove cellular debris. The cellular supernatant is contacted with one of the purification matrices of Example 2 for a period of time to allow complex formation. An environmental factor is applied to increase the size of the complexes. The purification matrix, with AAVs bound, is separated from impurities on the basis of size. The AAVs are eluted from the purification matrix by applying a second environmental factor. The AAVs are then titered and frozen at −80° C. for future use.

Example 4. Purification of Multiple AAV Serotypes Using a Purification Matrix Recombinant AAV particles, including AAV1, AAV2, AAV6, AAV8, and AAV9 particles, packaging a tdTomato transgene, were produced in a producer cell line (e.g., HEK293) according to standard protocols. The cells were lysed, and centrifuged to remove cellular debris. The cellular supernatant was contacted with a purification matrix having an amino acid sequence of SEQ ID NO: 171 for a period of time to allow complex formation. The purification matrix comprised an AAV binding polypeptide having an amino acid sequence of SEQ ID NO: 169 and a polypeptide with phase behavior having an amino acid sequence of SEQ ID NO: 170. An environmental factor (e.g. 0.5 M-2M NaCl, MgCl$_2$, or CaCl$_2$)) was then applied to increase the size of the complexes. The purification matrix, environmental factor, and cellular supernatant were incubated at room temperature for 15 minutes. Subsequently, the purification matrix, environmental factor, and cellular supernatant were concentrated (5-10 fold) using a 13 cm² hollow filter (0.2 μm pore size). Six wash diavolumes were performed using phosphate buffer solution and sodium chloride. This protocol allowed for separation of the purification matrix, with AAVs bound from impurities on the basis of size. The AAVs were eluted from the purification matrix by applying a buffer (e.g., the second environmental factor). The purification matrix was collected from the retentate. Various buffers were evaluated as shown in Table 5. The AAVs are then titered and frozen at −80° C. for future use.

TABLE 5

Buffers employed as the "second environmental factor"

| Environmental Factor | Composition of Second Environmental Factor |
|---|---|
| A | 0.5M Arginine (pH = 2); 0.6M NaCl |
| B | 0.1M Glycine (pH = 2); 0.6M NaCl |
| C | 0.1M Glycine (pH = 2); 0.6M MgCl$_2$ |
| D | 0.1M Glycine (pH = 2); 0.6M CaCl$_2$ |

Figure 2:
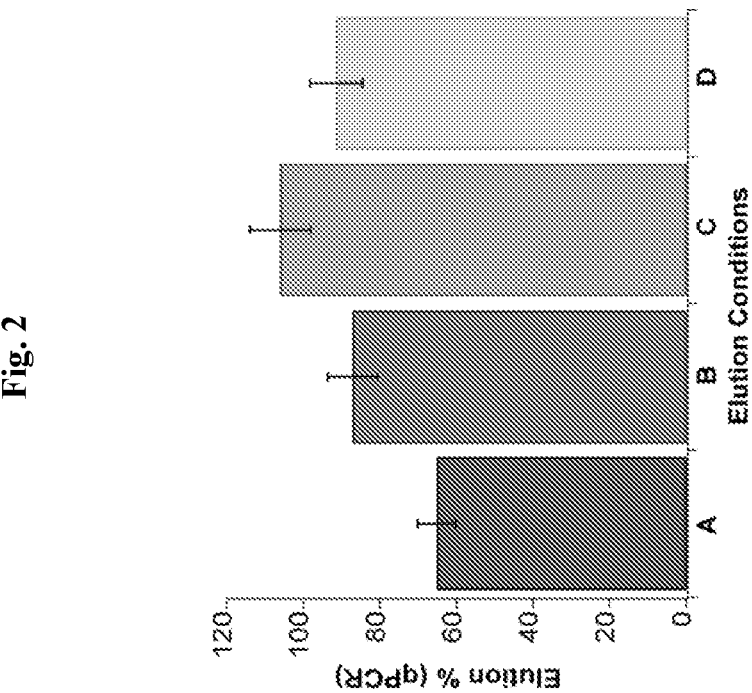
FIG. 2 shows the percentage of AAV particles eluted from the purification matrix, as determined by qPCR, using various elution conditions (e.g., second environmental factors).

Quantitative real-time polymerase chain reaction (qPCR) was utilized to evaluate the amount of AAV captured from solution and the amount of AAV obtained after elution. The purification matrix captured greater than 99% of AAV particles of multiple serotypes (AAV1, AAV2, AAV6, AAV8, and AAV9) (FIG. 1). Each buffer evaluated eluted over 65% of bound AAV particles in a single diavolume (FIG. 2).

The purification matrix was recycled after elution of the AAV particles to determine whether or not it could be utilized for future purifications. Recycling was performed by incubating the purification matrix at 95° C. for 5 minutes or soaking the purification matrix in 1 M NaOH or 6 M guanidine hydrochloride for five minutes.

As Table 6 shows, the purification matrix can be regenerated and utilized for repeated capture. After five cycles of purification/regeneration, the purification matrix captures 98% of AAV.

TABLE 6

Recycling of Purification Matrix

| # of times purification matrix has been used | Captured viral genome (vg)/ milliliter (mL) | % Capture |
|---|---|---|
| 1 | $8.46 \times 10^{10}$ | 97 |
| 2 | $8.60 \times 10^{10}$ | 98 |
| 3 | $8.61 \times 10^{10}$ | 99 |
| 4 | $8.57 \times 10^{10}$ | 98 |
| 5 | $8.53 \times 10^{10}$ | 98 |

Figure 3:
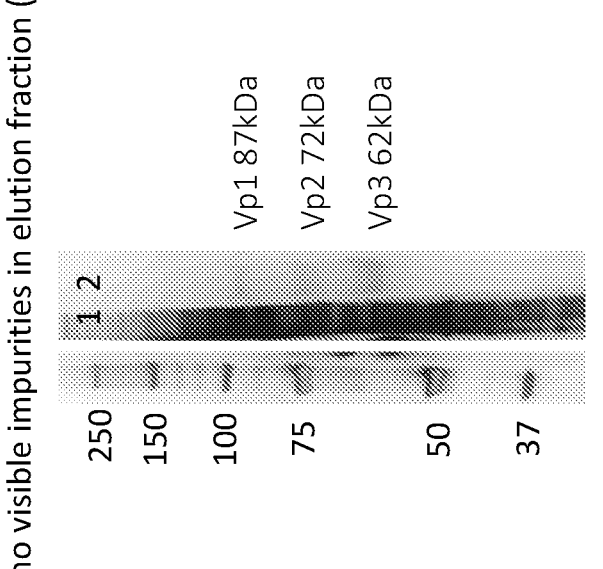
FIG. 3 provides an image of a silver-stained gel containing samples of (1) unpurified cellular supernatant, and (2) a sample comprising AAV particles purified according to the methods of the disclosure. In the sample containing AAV particles, bands for Vp1, Vp2, and Vp3 proteins were observed at the expected sizes (i.e., 87 kDa, 72 kDa, and 62 kDa, respectively).
Figure 4:
FIG. 4 provides an image of a Western Blot, showing that AAV VP1, VP2, and VP3 capsid proteins present in cellular supernatant were successfully captured and removed from the cellular supernatant using a purification matrix described herein.
Figure 4:
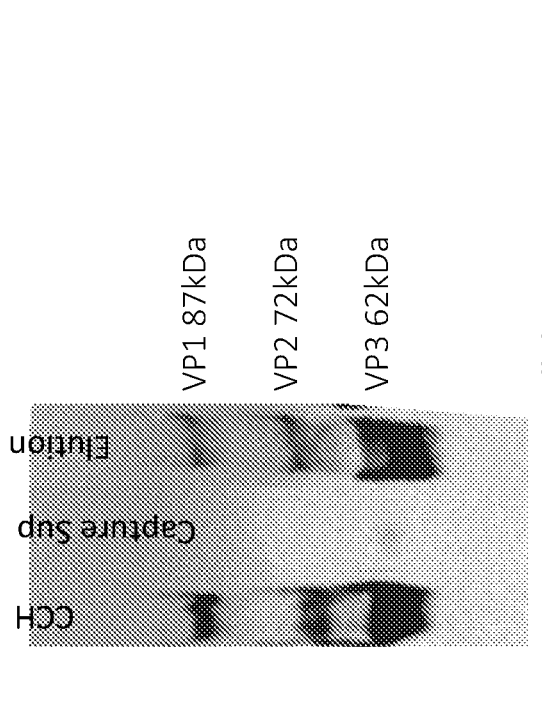

Sodium dodecycl sulfate-polyacrylamide gel electrophoresis (SDS-PAGE) was utilized to evaluate the purity of the eluted AAV samples. The gels were then silver stained, to visualize any contaminants in the sample. As shown in FIG. 3, the major AAV structural proteins Vp1, Vp2, and Vp3 were visible on the gel, but no other major bands were observed. A Western Blot confirmed the presence of capsid proteins in the sample that had been eluted from the purification matrix (FIG. 4). Furthermore, after the AAV particles were captured by the purification matrix, no AAV particles remained in the capture supernatant (Capture Sup of FIG. 4). Taken together, this data indicates that, after elution from the purification matrix, substantially all contaminants have been removed from the sample, and the isolated AAV has a high degree of purity.

In a subsequent experiment, it was evaluated whether the purification matrix is able to capture full capsids, empty capsids, or both. Total number of AAV capsids present in samples eluted from the purification matrix was estimated using an ELISA-based assay. The eluted samples were also evaluated using qPCR, to determine the number of viral genomes. A qPCR:ELISA value was used to approximate the ratio of full capsids relative to total capsids. As shown in Table 7, the purification matrix enriched for full capsids.

TABLE 7

Enrichment for Full AAV Capsid

| Method | Starting Quantity | Capture % | Elution Quantity | Change in Full % |
|---|---|---|---|---|
| qPCR | $5.78 \times 10^{10}$ | 99.2 | $5.73 \times 10^{10}$ | 33% → 70% |
| ELISA | $1.76 \times 10^{11}$ | 99.9 | $8.14 \times 10^{10}$ | |

Figure 5A:
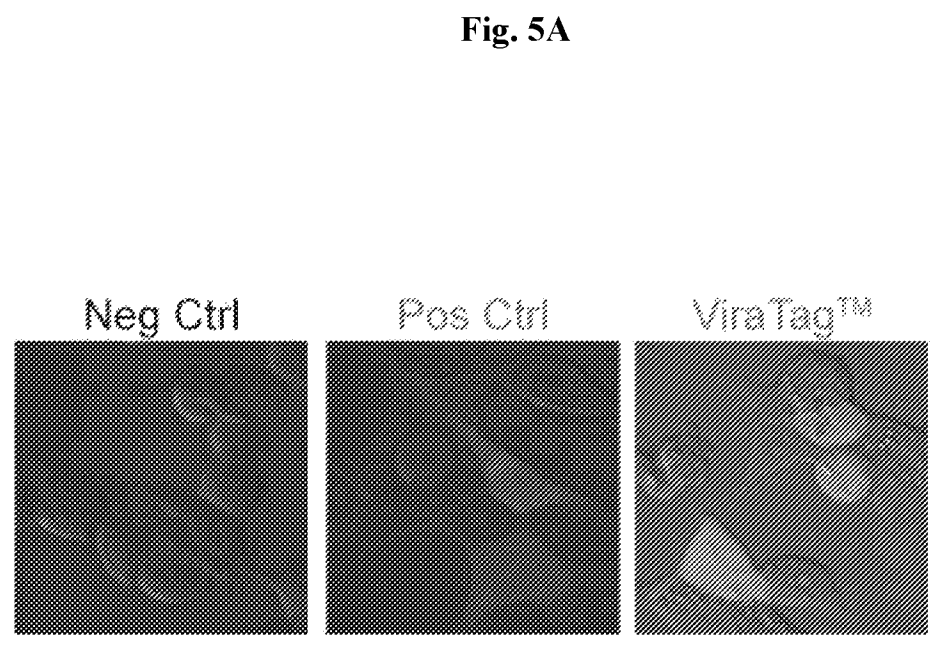
Figure 5B:
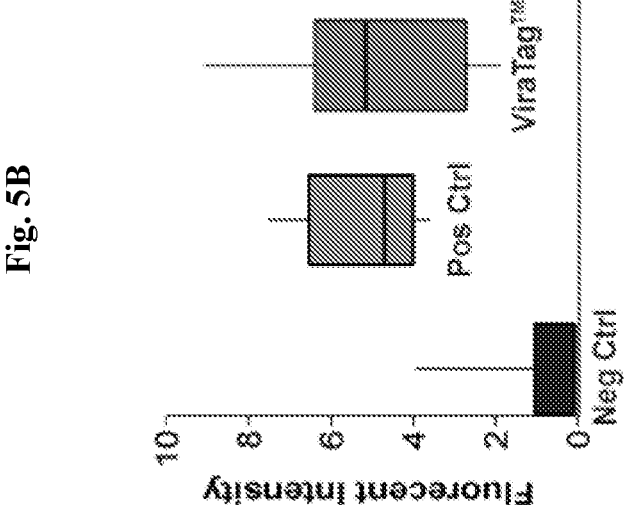
FIG. 5B shows the fluorescence intensity of cells infected with a control AAV particle (Pos Ctrl) or an AAV particle purified using a purification matrix as described herein (e.g. ViraTag™). Both types of AAV particles tested carried a tdTomato transgene.

The eluted AAV samples were also assayed to determine whether they maintained infectivity after purification. AAV8 carrying a tdTomato transgene was administered to HEK293 cells (10,000 cells/well) in culture at a multiplicity of infection (MOI) $1 \times 10^6$ or $1 \times 10^7$. After 48 of incubation, the cells were visualized for tdTomato fluorescence using fluorescence microscopy. As shown in FIG. 5A, AAV purified by the purification matrix (ViraTag™) infected cells to a similar extent as AAVs purified according to standard protocols (Pos Ctrl). This data was quantified, as shown in FIG. 5B. There was no statistically significant difference between infectivity levels of the AAV8 purified by standard protocols (Pos Ctrl) and the AAV8 purified by the purification matrix (ViraTag™). Accordingly, this data shows that AAV particles purified using the tested purification matrix (ViraTag™) retain high levels of infectivity.

Example 5. Purification of AAV9 Using a Purification Matrix and Tangential Flow Filtration (TFF)

HEK293 cells producing a recombinant AAV9 vector packaging a tdTomato transgene were grown in suspension and harvested by centrifugation. 200 mL of the supernatant were treated with 10 U/mL benzonase and 0.01% pluronic acid and sterile filtered through a 0.2-micron bottle-top filter. This starting material (SM) was then mixed with 1 µM of the purification matrix of Example 4 and 0.6 M NaCl salt (i.e., the first environmental factor) to form an AAV-purification matrix complex.

Figure 6:
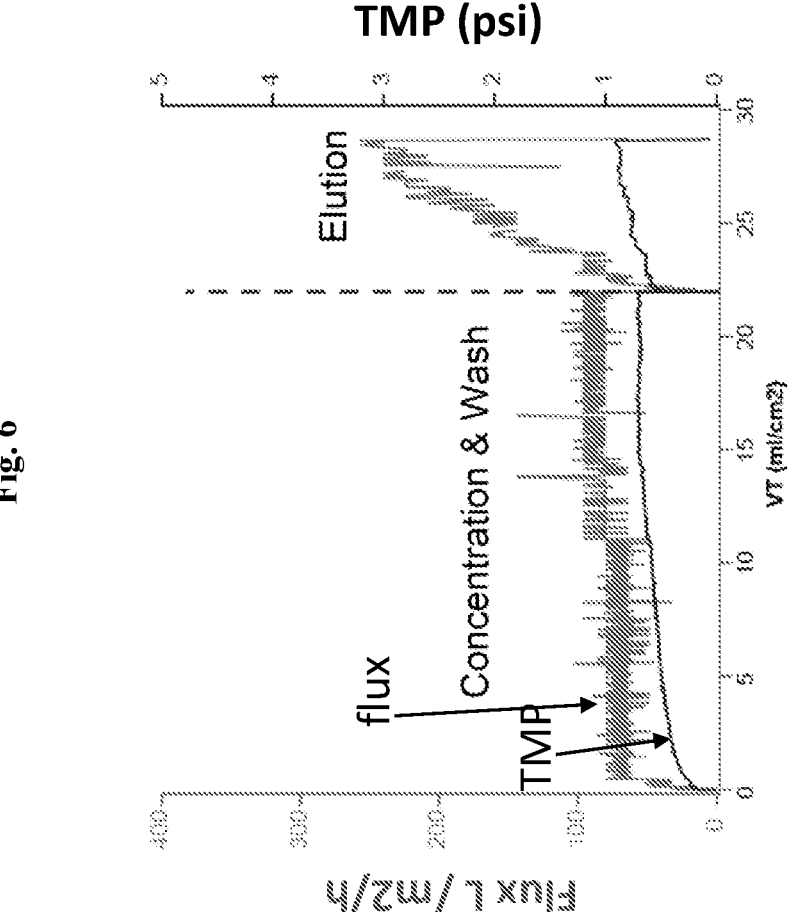
FIG. 6 is a graph that shows the tangential flow filtration flux and transmembrane pressure during the separation of an AAV9-purification matrix complex from impurities. The purification matrix can efficiently purify AAV9 particles with tangential flow filtration (TFF) in concentration-diafiltration-concentration-diafiltration (CDCD) mode. The process is performed at high flux and with a low and stable transmembrane pressure (TMP) in permeate-control mode.
Figure 7:
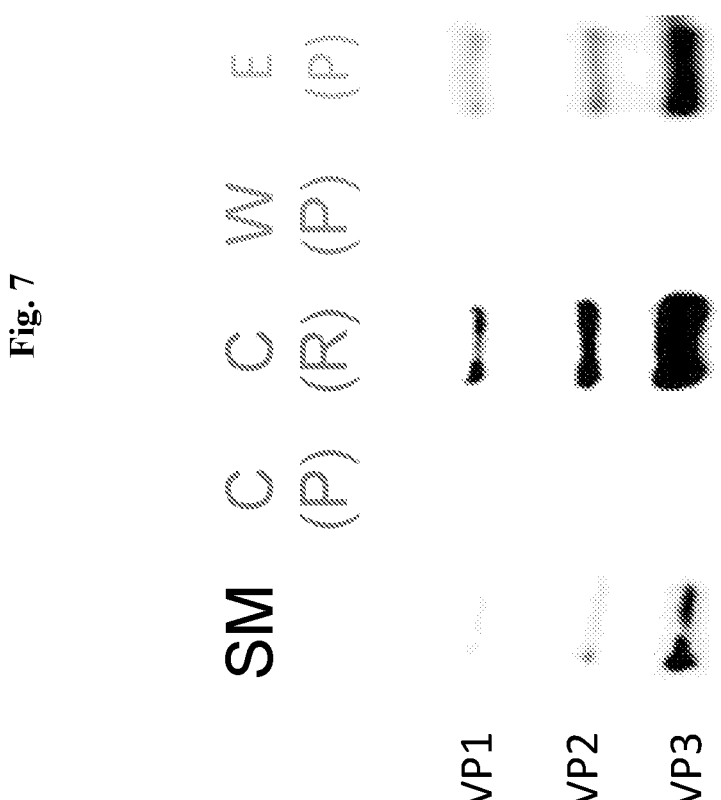
FIG. 7 is a western blot, which shows the presence or absence of VP1, VP2, and VP3 proteins of AAV, at different steps of the tangential flow filtration (TFF) process. The first lane, labeled SM (starting material) shows the presence of AAV particles in the starting material. The SM is supernatant from cultured HEK293 cells producing a recombinant AAV9 vector packaging a tdTomato transgene that is treated with 10 U/mL benzonase and 0.01% pluronic acid. The second lane, labeled C (P), shows the absence of AAV particles in the permeate. The third lane, labeled C (R), shows the presence of AAV particles in the retentate. The fourth lane, labeled W(P), shows the absence of AAV particles in the wash containing removed contaminants. The fifth lane, labeled E(P), shows the eluted AAV particles.
Figure 8:
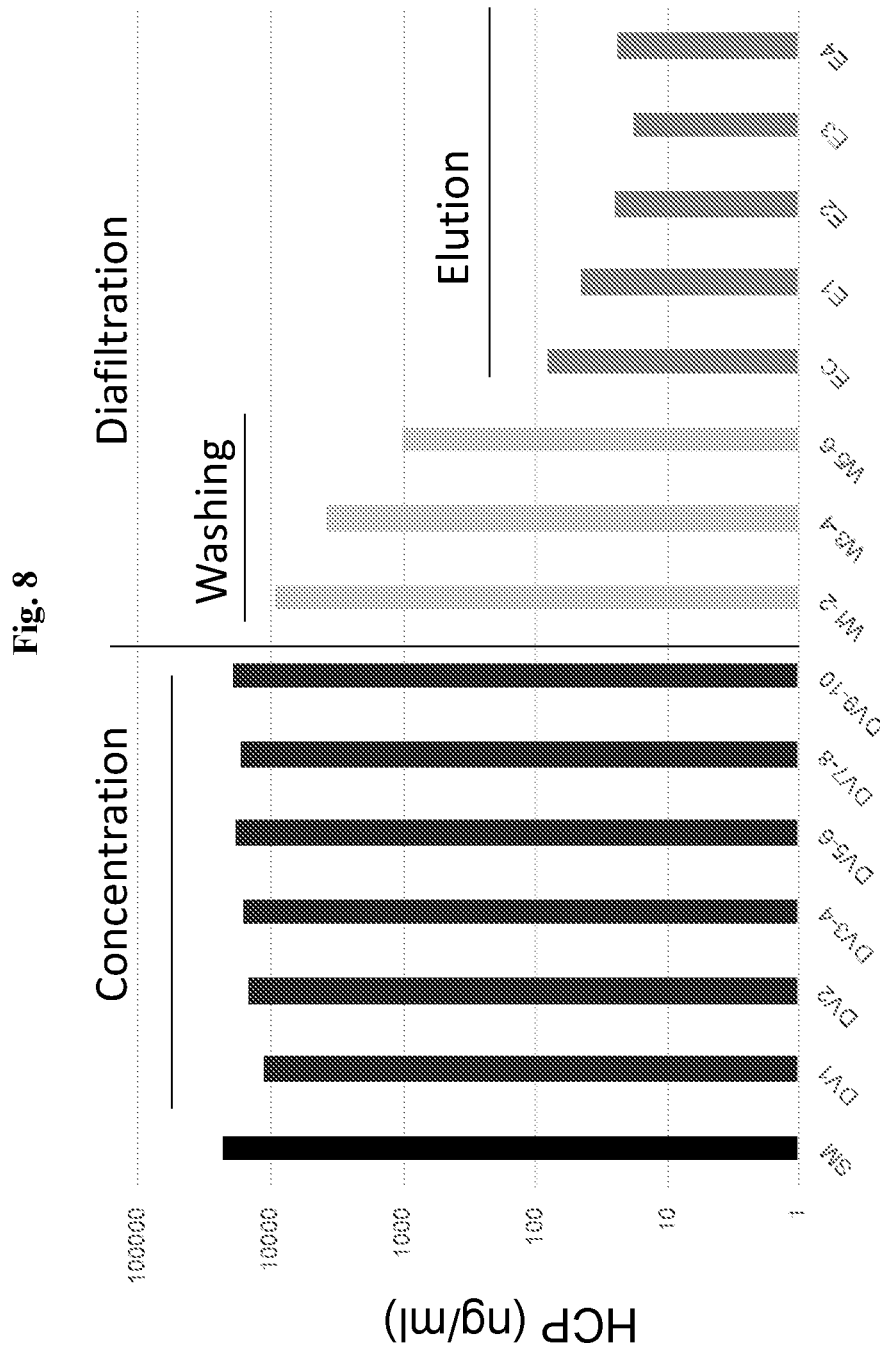
FIG. 8 is a graph showing quantitation of contaminant host cell proteins (HCP) within a composition containing an AAV-purification matrix complex during TFF concentration and diafiltration. The composition containing the AAV-purification matrix complex is referred to as SM or "starting material" and contains AAV particles of serotype AAV9. Throughout the concentration and diafiltration stages of TFF, 1 mL fractions are collected. DV1, DV2, DV3-4, DV5-6, DV7-8, and DV9-10 refer to fractions collected during the concentration stage of TFF. W1-2, W3-4, and W5-6 refer to fractions collected during the washing stage of diafiltration. EC, E1, E2, E3, and E4 refer to fractions collected during the elution stage of diafiltration.
Figure 9:
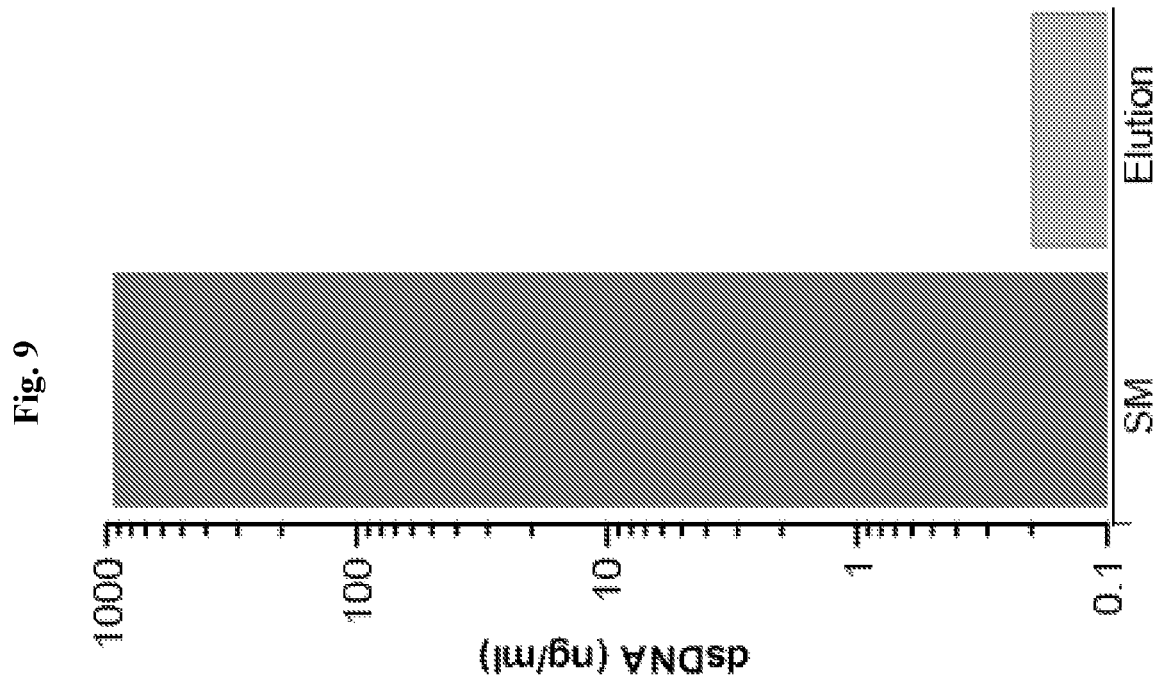
FIG. 9 is a graph showing the concentration of double stranded DNA (dsDNA) impurities in a composition comprising AAV9 particles before purification with a purification matrix (referred to as starting material (SM)) and after purification with a purification matrix (referred to as "elution").

This SM was processed in continuous fed-batch mode using a Repligen KR2i tangential-flow filtration (TFF) unit. The TFF was setup with a 20 mL retentate vessel, prepared with 50 µM purification matrix and 0.6 M NaCl, as well as a 13 cm² hollow fiber filter with 0.2-micron pores. A concentration-diafilter (CD) mode (10×concentration factor (CF), 6×diavolumes (DV) was run in permeate control with the SM and permeate pump set to equal flow rates. Once the entire 200 mL SM feed was processed, the retained material was rinsed with 6 DV of wash buffer (20 mM Tris, 0.5M NaCl). The AAV9 material, now free of contaminants, was then resolubilized on ice and mixed with an equal volume of 2×Elution buffer (i.e., a second environmental factor) with the permeate valve closed. The elution buffer contained 100 mM glycine at pH 3 and 0.6 M NaCl. After 20 minutes, the recirculating sample was warmed back to room temperature and phase separated with NaCl. The permeate valve was opened and pure AAV9 was collected in a second CD mode (2×CF, 4×DV) with elution buffer diavolumes (100 mM glycine, pH 3, 0.6M NaCl). The flux and transmembrane pressure (TMP) were tracked throughout the run (FIG. 6), demonstrating a stable, efficient, and scalable process. Permeate and retentate samples were collected throughout the run for analysis of AAV loss by anti-AAV Western Blot (FIG. 7), as well as purity by host cell protein (HCP) quantification using a HEK HCP ELISA (Cygnus®) and dsDNA quantification using a Quant-iT™ Picogreen Assay® (Thermo Fisher®). The process enabled removal of HCPs by 2-3 log (FIG. 8) and of double stranded DNA (dsDNA) by >3 log (FIG. 9).

Example 6. Effect of Titer, Clarification, and Nuclease Treatment on AAV Purification The ability of the purification matrix of Example 4 to capture AAV8 particles from cell lysate or the media of suspension cultures of HEK293 cells producing AAV8 particles (referred to in FIG. 10 as "supernatant"). The cell lysate was produced by resuspending pelleted HEK293 cells producing AAV8 particles in 0.5% Triton-X-100.

The cell lysate and media evaluated contained titers of AAV particles that ranged from $1 \times 10^8$ to $1 \times 10^7$ viral particles per microliter (vp/µL). The ability of purification matrix to capture AAV8 particles from cell lysate treated with nuclease was also evaluated. Cell lysates that were treated with nuclease were incubated for 1 hr at 34° C. with 50 U/mL benzonase (Millipore®).

The ability of purification matrix to capture AAV8 particles from clarified cell lysate or media was also evaluated. Cell lysates and/or media were clarified by centrifugation at 13,200 rpm for 10 minutes. The supernatant was used for subsequent isolation of the AAV8 particles. for 10 min at 13,200 rpm.

AAV8 particles were isolated from each sample by mixing the sample with 10 µM purification matrix and 0.6 M NaCl (i.e., a first environmental factor) and centrifuging the sample at 13,200 rpm for 10 minutes.

The pellets containing AAV-purification matrix complex were resuspended on ice in an elution buffer (i.e., second environmental factor) comprising 100 mM glycine at pH 3, warmed to room temperature, transitioned with 0.6 M salt, and then centrifuged a second time. The amount of eluted AAV8 was compared to that in the starting material, (i.e the media or cell lysate comprising AAV8 particles) using inverted terminal repeat (ITR) quantitative polymerase chain reaction (qPCR). This technique quantitates the number of AAV particles by measuring the number of ITRs using PCR. The AAV Capture Efficiency for each sample was calculated using the following equation: 100×(# of AAV8 particles captured by the purification matrix/# of AAV8 particles in the composition before purification).

Figure 10:
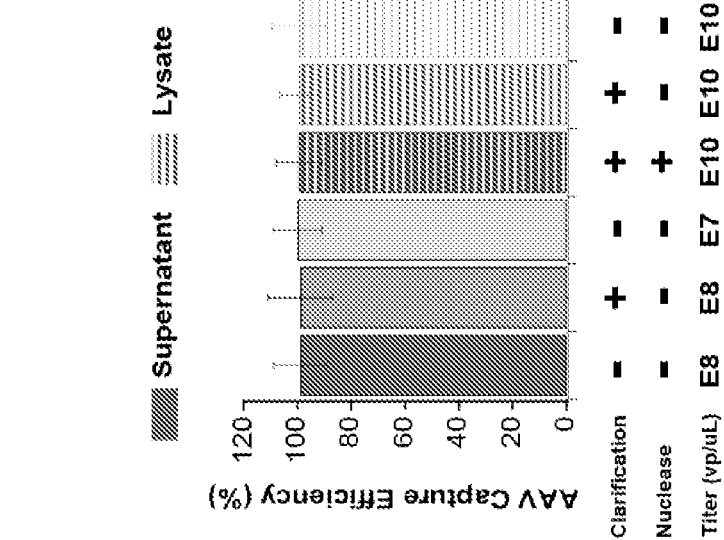
FIG. 10 is a graph that shows the effect of a composition of AAV8 particles on a purification matrix's "AAV Capture Efficiency." The compositions comprising AAV8 particles included compositions from the cell lysate of HEK293 cells producing AAV8 particles, referred to as lysate," and compositions comprising media harvested from HEK293 cells producing AAV8 particles, referred to as "supernatant". The compositions contained viral titers of $1\times10^7$ viral particles per microliter (vp/uL) (referred to as "E7"), $1\times10^8$ vp/uL, or $1\times10^{10}$ vp/uL. The compositions were clarified (+) or not clarified (–). The compositions were exposed to nuclease (+) or not exposed to nuclease (–). A purification matrix was used to capture AAV8 particles from each composition. The AAV Capture Efficiency for each sample was calculated using the following equation: 100×(# of AAV8 particles captured by the purification matrix # of AAV8 particles in the composition before purification).
Figure 11:
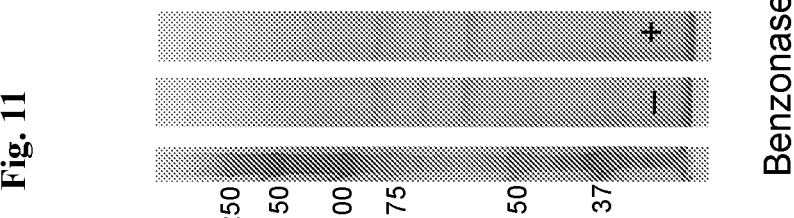
FIG. 11 provides an image of a silver stained SDS-PAGE gel, which shows that purification of AAV8 particles with purification matrix yields highly pure AAV8 particles, regardless of pre-treatment with benzonase nuclease. (–) indicates no pre-treatment with benzonase nuclease was performed, and (+) indicates that pre-treatment was performed.
Figure 12:
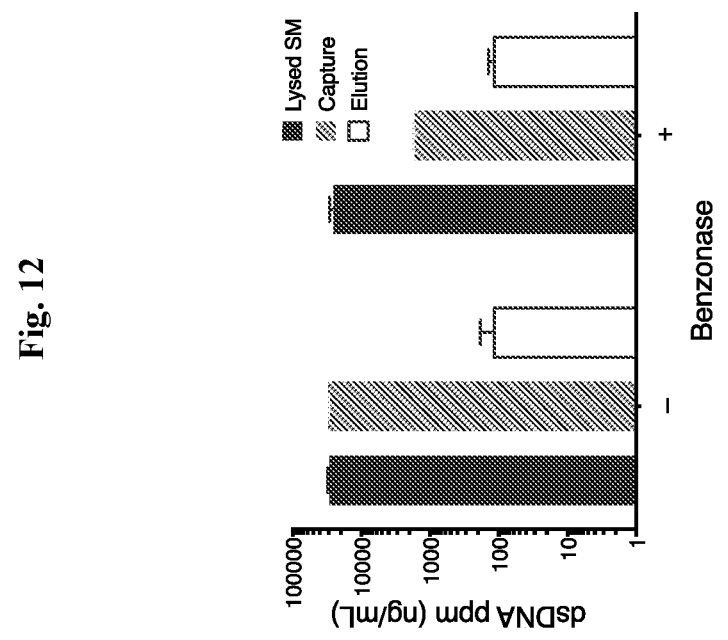

The purification matrix robustly captured >98% AAV particles regardless of titer ($1\times10^7$ to $4\times10^{10}$), clarification, nuclease treatment, or lysate versus media as the starting material (FIG. 10). Evaluation of lysate samples with and without nuclease treatment showed that nuclease treatment did not impact final eluted AAV8 particle purity when compared by silver stain SDS-PAGE (FIG. 11) and Quant-iT™ picogreen assay for dsDNA (FIG. 12).

Example 7. Effect of Centrifugation Speed on AAV8 Capture

Figure 13:
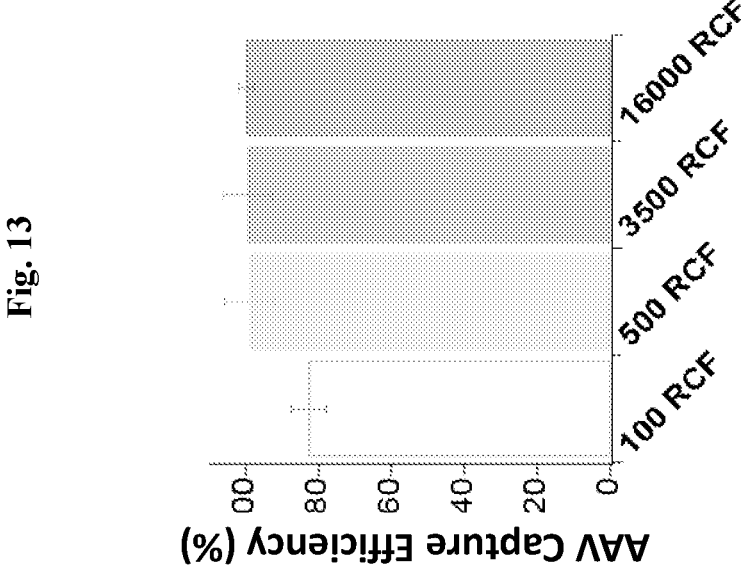
FIG. 13 shows AAV Capture Efficiency after centrifugation at various speeds. The figure shows that >95% capture of AAV8 particles is achieved using centrifugation speeds at or greater than 500 relative centrifugal force (RCF), including 3500 and 16000 RCF.

Harvested media from AAV8 HEK293 suspension cell culture was mixed with 10 µM Purification Matrix and 0.6 M NaCl to form an AAV-purification matrix complex. The samples were centrifuged for 10 min at relative centrifugal forces (RCF) ranging from 100 to 16,000. For each RCF, uncaptured AAV8 remaining in the supernatant was quantified using ITR qPCR and calculated as a percentage of the amount measured in the starting harvest material. The AAV Capture Efficiency was measured as 100% less the percentage remaining uncaptured in the supernatant and results showed that speeds of 500 RCF or higher yielded highly efficient AAV8 capture (FIG. 13).

Example 8. Stabilization of AAV2 by Purification Matrix

Figure 14:
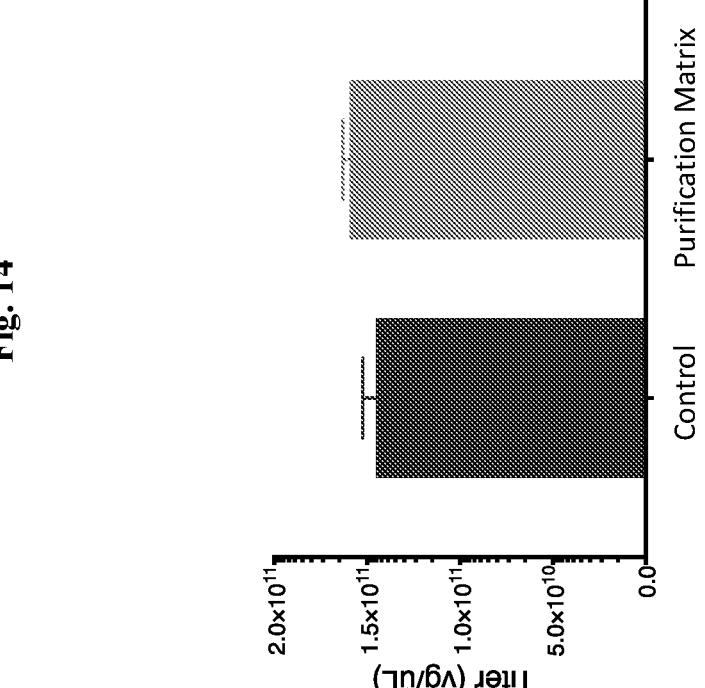
FIG. 14 shows a comparison of the AAV2 titers produced by HEK293 cell cultures under standard conditions (control) or with the addition of purification matrix as quantified by inverted terminal repeat (ITR) quantitative polymerase chain reaction (qPCR) The data shows that the presence of purification matrix may increase titers by 8% or more. Student's t-test, p=0.077.

Adherent HEK293 cells were transfected according to a standard triple transfection method, and used to produce recombinant AAV2 particles carrying a luciferase transgene. The cells were cultured for 6 days, in the presence or absence of purification matrix. Cells cultured in the presence of 10 µM of the purification matrix of Example 4 were compared to control cells, with each group, treatment or control, in triplicate. The culture media was collected on day 4 and replaced with an equal volume of media with or without the purification matrix additive. On day 6, the media was collected again and the cells were rinsed with PBS and harvested by scraping. The total vector genomes collected in all fractions were quantified for comparison using qPCR using primers against ITR2. Inclusion of the purification matrix in the culture media increased vector genome (vg) titers by at least 8% (FIG. 14).

Example 9. Stabilization of AAV8 by Purification Matrix

Figure 15:
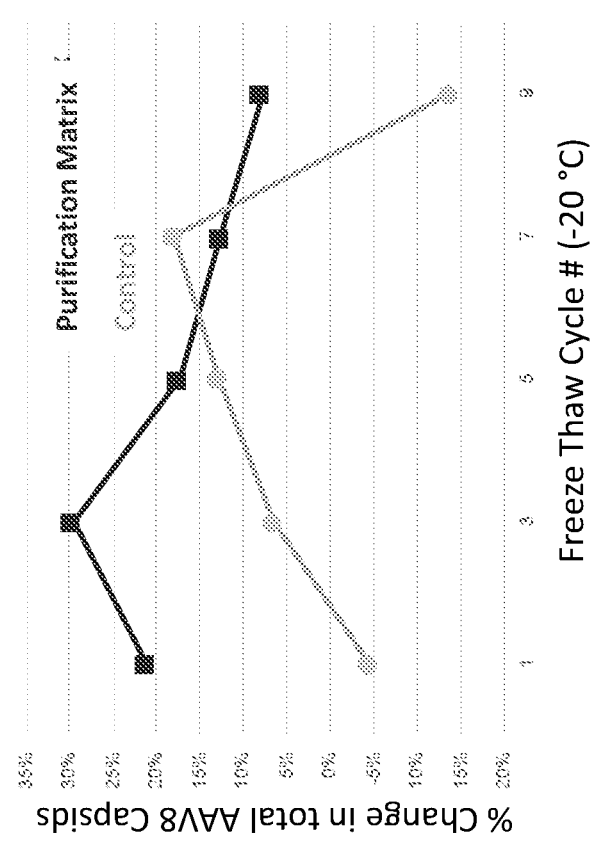
FIG. 15 shows the percent change of total AAV8 capsids after repeated freeze-thaw cycles in a composition comprising AAV8 particles and purification matrix and a composition comprising AAV8 particles and PBS (negative control).

Media was harvested from HEK293 cells grown in suspension, wherein the cells were producing GFP-AAV8. The media was aliquoted and stored at −20° C. either with or without the addition of 100 µM of the purification matrix of Example 4. As an accelerated stability study, the samples were subjected to freeze-thaw cycles (−20° C. to room temperature) and then assayed using a AAV8 ELISA (Progen), which quantifies total intact AAV particles. The quantified particles for the control and purification matrix-treated samples were normalized to the starting materials with no freeze-thaws. This data indicates that the purification matrix may enhance the resistance of AAV particles to freeze-thaw-mediated degradation and aggregation (FIG. 15).

Example 10. Capture of AAV8 Particles with a Purification Matrix

Figure 16:
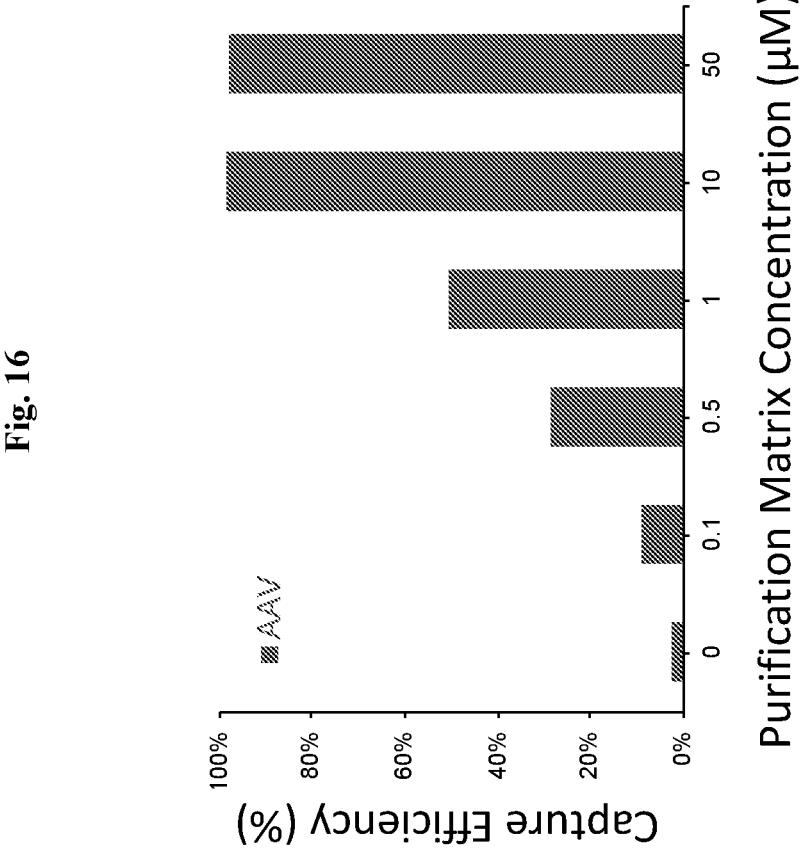
FIG. 16 is a graph showing the effect of purification matrix concentration on the Capture Efficiency of AAV8 particles. The Capture Efficiency was calculated using the following equation: 100×(# of AAV8 particles captured by the purification matrix/# of AAV8 particles in the composition before purification).

Media was harvested from HEK293 suspension cells producing AAV8 particles carrying a luciferase (luc) transgene. The media was contacted with 0 µM, 0.1 µM, 0.5 µM, 1 µM, 10 µM, and 50 µM of the purification matrix of Example 4, resulting in the formation of complexes between AAV8 particles and purification matrix. A first environmental factor (i.e. 0.6 M NaCl) was applied to increase the size of the complexes. Subsequently, the media containing the complexes was centrifuged at 13,200 revolutions per minute (rpm) for 10 minutes (min). This protocol allowed for separation of the complexes from impurities on the basis of size. Inverted terminal repeat (ITR) quantitative polymerase chain reaction (qPCR) was utilized to evaluate the amount of AAV particles captured from the media using the purification matrix compared to the amount of AAV particles in the starting material. This technique quantitates the number of AAV particles by measuring the number of ITRs using PCR. The Capture Efficiency of the purification matrix at each concentration was calculated using the following equation: 100×(# of AAV8 particles captured by the purification matrix/# of AAV8 particles in the composition before purification). FIG. 16 shows that purification matrix concentrations at or above 10 µM are sufficient for robust, >98%, virus capture.

NUMBERED EMBODIMENTS OF THE DISCLOSURE

Notwithstanding the appended claims, the disclosure sets forth the following numbered embodiments:

1. A purification matrix comprising an AAV-binding polypeptide coupled to a support, wherein the AAV-binding polypeptide comprises the ectodomain of the AAV receptor (AAVR), or an AAV-binding fragment or derivative thereof.
2. The purification matrix of embodiment 1, wherein the AAVR is a human AAVR.
3. The purification matrix of embodiment 1, wherein the AAVR is a monkey AAVR
4. The purification matrix of embodiment 1, wherein the AAVR is an orangutan AAVR.
5. The purification matrix of embodiment 1, wherein the AAVR is a mouse AAVR.
6. The purification matrix of any one of embodiments 1-5, wherein the AAVR is a wildtype AAVR
7. The purification matrix of any one of embodiments 1-5, wherein the AAVR is a mutant AAVR 8. The purification matrix of embodiment 1, wherein the AAV-binding polypeptide comprises the sequence of SEQ ID NO: 33.

9. The purification matrix of embodiment 1, wherein the AAV-binding polypeptide comprises the sequence of SEQ ID NO: 33 with up to 25 amino acid mutations.

10. The purification matrix of embodiment 1, wherein the AAV-binding domain comprises amino acids 411 to 499 of SEQ ID NO: 35 with at least one, at least two, at least three, at least four, or at least five mutations, wherein each mutation is individually selected from the group consisting of V440H, S431H, Q432H, T434H, Y442H, I462H, D435H, D436H, K438H, and I439H.

11. The purification matrix of embodiment 1, wherein the AAV-binding polypeptide comprises any one of SEQ ID NOs: 28-32, 37-41, 43-47, and 52-86.

12. The purification matrix of embodiment 1, wherein the AAV-binding polypeptide comprises at least two, at least three, at least four, or at least five of SEQ ID NOs: 28-32, 37-41, 43-47, and 52-86.

13. The purification matrix of embodiment 1, wherein the AAV-binding polypeptide comprises a polycystic kidney disease 1 (PKD1) domain, or a fragment thereof.

14. The purification matrix of embodiment 1, wherein the AAV-binding polypeptide comprises a polycystic kidney disease 2 (PKD2) domain, or a fragment thereof.

15. The purification matrix of embodiment 1, wherein the AAV-binding polypeptide comprises a polycystic kidney disease 3 (PKD3) domain, or a fragment thereof.

16. The purification matrix of embodiment 1, wherein the AAV-binding polypeptide comprises a polycystic kidney disease 4 (PKD4) domain, or a fragment thereof.

17. The purification matrix of embodiment 1, wherein the AAV-binding polypeptide comprises a polycystic kidney disease 5 (PKD5) domain, or a fragment thereof.

18. The purification matrix of embodiment 1, wherein the AAV-binding polypeptide comprises a sequence of SEQ ID NO: 29.

19. The purification matrix of embodiment 18, wherein the AAV-binding polypeptide comprises a sequence of SEQ ID NO: 29 wherein at least one amino acid is mutated to histidine.

20. The purification matrix of any one of embodiments 1-19, wherein the support is a bead, a resin, a membrane, a fiber, a polymer, a plate, or a chip.

21. The purification matrix of embodiment 20, wherein the support is a bead comprising sepharose, agarose, cellulose, polystyrene, polymethacrylate, and/or polyacrylamide.

22. The purification matrix of embodiment 20, wherein the support is a magnetic bead.

23. The purification matrix of embodiment 20, wherein the support is a polymer.

24. The purification matrix of embodiment 23, wherein the support is a synthetic polymer.

25. The purification matrix of any one of embodiments 1-24, wherein the AAV binding polypeptide is reversibly coupled to the support.

26. The purification matrix of any one of embodiments 1-24, wherein the AAV binding polypeptide is covalently coupled to the support.

27. The purification matrix of any one of embodiments 1-24, wherein the AAV binding polypeptide is non-covalently coupled to the support.

28. The purification matrix of any one of embodiments 1-27, wherein the AAV binding polypeptide is coupled to the support via a linker.

29. The purification matrix of embodiment 28, wherein the linker is a peptide linker.

30. The purification matrix of embodiment 29, wherein the peptide linker comprises a protease cleavage site.

31. The purification matrix of embodiment 28, wherein the linker is a chemical linker.

32. The purification matrix of any one of embodiments 1 to 31, wherein the purification matrix is reusable.

33. The purification matrix of any one of embodiments 1 to 31, wherein the purification matrix comprises an AAV binding polypeptide having the amino acid sequence of SEQ ID NO: 9.

34. The purification matrix of any one of embodiments 1 to 31, wherein the purification matrix comprises an AAV binding polypeptide having the amino acid sequence of SEQ ID NO: 52.

35. The purification matrix of any one of embodiments 1 to 31, wherein the purification matrix comprises an AAV binding polypeptide having the amino acid sequence of SEQ ID NO: 64.

36. A purification matrix comprising an AAV-binding polypeptide coupled to a polypeptide having phase behavior, wherein the AAV-binding polypeptide comprises the ectodomain of the AAV receptor (AAVR), or an AAV-binding fragment or derivative thereof.

37. The purification matrix of embodiment 36, wherein the AAVR is a human AAVR.

38. The purification matrix of embodiment 36, wherein the AAVR is a monkey AAVR.

39. The purification matrix of embodiment 36, wherein the AAVR is an orangutan AAVR.

40. The purification matrix of embodiment 36, wherein the AAVR is a mouse AAVR.

41. The purification matrix of any one of embodiments 36-40, wherein the AAVR is a wildtype AAVR.

42. The purification matrix of any one of embodiments 36-40, wherein the AAVR is a mutant AAVR 43. The purification matrix of embodiment 36, wherein the AAV-binding polypeptide comprises the sequence of SEQ ID NO: 33.

44. The purification matrix of embodiment 36, wherein the AAV-binding polypeptide comprises the sequence of SEQ TD NO: 33 with up to 25 amino acid mutations.

45. The purification matrix of embodiment 36, wherein the AAV-binding domain comprises amino acids 411 to 499 of SEQ ID NO: 35 with at least one, at least two, at least three, at least four, or at least five mutations, wherein each mutation is individually selected from the group consisting of V440H, S431H, Q432H, T434H, Y442H, I462H, D435H, D436H, K438H, and I439H.

46. The purification matrix of embodiment 36, wherein the AAV-binding polypeptide comprises any one of SEQ ID NOs: 28-32, 37-41, 43-47, and 52-86.

47. The purification matrix of embodiment 36, wherein the AAV-binding polypeptide comprises at least two, at least three, at least four, or at least five of SEQ ID NOs: 28-32, 37-41, 43-47, and 52-86.

48. The purification matrix of embodiment 36, wherein the AAV-binding polypeptide comprises a polycystic kidney disease 1 (PKD1) domain, or a fragment thereof.

49. The purification matrix of embodiment 36, wherein the AAV-binding polypeptide comprises a polycystic kidney disease 2 (PKD2) domain, or a fragment thereof.

50. The purification matrix of embodiment 36, wherein the AAV-binding polypeptide comprises a polycystic kidney disease 3 (PKD3) domain, or a fragment thereof.

51. The purification matrix of embodiment 36, wherein the AAV-binding polypeptide comprises a polycystic kidney disease 4 (PKD4) domain, or a fragment thereof.

52. The purification matrix of embodiment 36, wherein the AAV-binding polypeptide comprises a polycystic kidney disease 5 (PKD5) domain, or a fragment thereof.

53. The purification matrix of embodiment 36, wherein the AAV-binding polypeptide comprises a sequence of SEQ ID NO: 29.

54. The purification matrix of embodiment 53, wherein the AAV-binding polypeptide comprises a sequence of SEQ ID NO: 29 wherein at least one amino acid is mutated to histidine.

55. The purification matrix of any one of embodiments 36-54, wherein the AAV binding polypeptide is reversibly coupled to the polypeptide having phase behavior.

56. The purification matrix of any one of embodiments 36-54, wherein the AAV binding polypeptide is covalently coupled to the polypeptide having phase behavior.

57. The purification matrix of any one of embodiments 36-54, wherein the AAV binding polypeptide is non-covalently coupled to the polypeptide having phase behavior.

58. The purification matrix of any one of embodiments 36-57, wherein the AAV binding polypeptide is coupled to the polypeptide having phase behavior via a linker.

59. The purification matrix of embodiment 58, wherein the linker is a peptide linker.

60. The purification matrix of embodiment 58, wherein the peptide linker comprises a protease cleavage site.

61. The purification matrix of embodiment 58, wherein the linker is a chemical linker.

62. The purification matrix of any one of embodiments 36-61, wherein a fusion protein comprises the AAV binding polypeptide and the polypeptide having phase behavior.

63. The purification matrix of any one of embodiments 36-62, wherein the polypeptide with phase behavior is an elastin-like polypeptide.

64. The purification matrix of any one of embodiments 36-62, wherein the polypeptide with phase behavior is a resilin-like polypeptide.

65. The purification matrix of embodiment 63, wherein the polypeptide with phase behavior is a polymer comprising a pentapeptide repeat having the sequence (Val-Pro-Gly-Xaa-Gly)$_n$ (SEQ ID NO: 10), or a randomized, scrambled analog thereof; wherein Xaa can be any amino acid except proline.

66. The purification matrix of embodiment 65, wherein n is an integer between 1 and 360, inclusive of endpoints.

67. The purification matrix of any one of embodiments 1-63, wherein the polypeptide with phase behavior comprises an amino acid sequence selected from:

a.
(SEQ ID NO: 1)
(GRGDSPY)$_n$ b.
(SEQ ID NO: 2)
(GRGDSPH)$_n$ c.
(SEQ ID NO: 3)
(GRGDSPV)$_n$ d.
(SEQ ID NO: 4)
(GRGDSPYG)$_n$

-continued e.
(SEQ ID NO: 5)
(RPLGYDS)$_n$ (f.
(SEQ ID NO: 6)
(RPAGYDS)$_n$ (g.
(SEQ ID NO: 7)
(GRGDSYP)$_n$ (h.
(SEQ ID NO: 8)
(GRGDSPYQ)$_n$ i.
(SEQ ID NO: 9)
(GRGNSPYG)$_n$ j.
(SEQ ID NO: 11)
(GVGVP)$_n$;

k.
(SEQ ID NO: 12)
(GVGVPGLGVPGVGVPGLGVPGVGVP)$_m$;

l.
(SEQ ID NO: 13)
(GVGVPGVGVPGAGVPGVGVPGVGVP)$_m$;

m.
(SEQ ID NO: 14)
(GVGVPGWGVPGVGVPGWGVPGVGVP)$_m$;

n.
(SEQ ID NO: 15)
(GVGVPGVGVPGVGVPGVGVPGVGVPGVGVPGEGVPGFGVPGVGVP)$_m$;

o.
(SEQ ID NO: 16)
(GVGVPGVGVPGVGVPGVGVPGVGVPGVGVPGKGVPGFGVPGVGVP)$_m$;
and p.
(SEQ ID NO: 17)
(GAGVPGVGVPGAGVPGVGVPGAGVP)$_m$;

or a randomized, scrambled analog thereof;
wherein:
n is an integer in the range of 20-360; and
m is an integer in the range of 4-25.

68. The purification matrix of any one of embodiments 1-63, wherein the polypeptide with phase behavior comprises an amino acid sequence selected from:

(a)
(SEQ ID NO: 143)
(GVGVP)$_m$;

(b)
(SEQ ID NO: 148)
(ZZPXXXXGZ)$_m$;

(c)
(SEQ ID NO: 149)
(ZZPXGZ)$_m$;

(d)
(SEQ ID NO: 150)
(ZZPXXGZ)$_m$;
or (e)
(SEQ ID NO: 151)
(ZZPXXXGZ)$_m$, wherein m is an integer between 10 and 160, inclusive of endpoints, wherein X if present is any amino acid except proline or glycine, and wherein Z if present is any amino acid.

69. The purification matrix of any one of embodiments 1-63, wherein the polypeptide with phase behavior comprises an amino acid sequence selected from:

(a)
$$(SEQ ID NO: 144)$$
$(GVGVPGVGVPGAGVPGVGVPGVGVP)_m;$
or (b)
$$(SEQ ID NO: 146)$$
$(GVGVPGVGVPGLGVPGVGVPGVGVP)_m;$ wherein m is an integer between 2 and 32, inclusive of endpoints.

70. The purification matrix of any one of embodiments 1-63, wherein the polypeptide with phase behavior comprises an amino acid sequence selected from:
   (a) $(GVGVPGVGVPGAGVPGVGVPGVGVP)_m$, (SEQ ID NO: 144), wherein m is 8 or 16;
   (b) $(GVGVPGAGVP)_m$ (SEQ ID NO: 145), wherein m is an integer between 5 and 80, inclusive of endpoints; or
   (c) $(GXGVP)_m$ (SEQ ID NO: 147), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

71. The purification matrix of any one of embodiments 36 to 70, wherein the purification matrix is reusable.

72. The purification matrix of any one of embodiments 36 to 70, wherein the purification matrix comprises an AAV binding polypeptide having the amino acid sequence of SEQ ID NO: 29.

73. The purification matrix of any one of embodiments 36 to 70, wherein the purification matrix comprises an AAV binding polypeptide having the amino acid sequence of SEQ ID NO: 52.

74. The purification matrix of any one of embodiments 36 to 70, wherein the purification matrix comprises an AAV binding polypeptide having the amino acid sequence of SEQ ID NO: 64.

75. The purification matrix of any one of embodiments 36 to 70, wherein the purification matrix comprises an AAV binding polypeptide having the amino acid sequence of SEQ ID NO: 29 and a polypeptide with phase behavior comprising the amino acid sequence of SEQ ID NO: 88 or $(GVGVPGLGVPGVGVPGLGVPGVGVP)_m$ (SEQ ID NO: 12), wherein m is 16.

76. The purification matrix of any one of embodiments 36 to 70, wherein the purification matrix comprises an AAV binding polypeptide having the amino acid sequence of SEQ ID NO: 52 and a polypeptide with phase behavior comprising the amino acid sequence of SEQ ID NO: 88 or $(GVGVPGLGVPGVGVPGLGVPGVGVP)_m$ (SEQ ID NO: 12), wherein m is 16.

77. The purification matrix of any one of embodiments 36 to 70, wherein the purification matrix comprises an AAV binding polypeptide having the amino acid sequence of SEQ ID NO: 64 and a polypeptide with phase behavior comprising the amino acid sequence of SEQ ID NO: 88 or $(GVGVPGLGVPGVGVPGLGVPGVGVP)_m$ (SEQ ID NO: 12), wherein m is 16.

78. The purification matrix of any one of embodiments 36 to 70, wherein the purification matrix comprises an amino acid sequence of any one of SEQ ID NOs: 87 and 171-174.

79. A method for purifying an AAV, the method comprising contacting the AAV with the purification matrix of any one of embodiments 1-35.

80. The method of embodiment 79, wherein the AAV comprises a wildtype AAV capsid.

81. The method of embodiment 79, wherein the AAV comprises a mutant AAV capsid.

82. The method of embodiment 79, wherein the AAV comprises a capsid of any one of the following serotypes: AAV1, AAV2, AAV3, AAV4, AAV5, AAV6, AAV7, AAV8, AAV9, AAV10, AAV11, AAV12, AAVrh8, AAVrh10, or AAVrh74.

83. The method of any one of embodiments 79-82, wherein the AAV reversibly binds to the purification matrix to form an AAV-purification matrix complex.

84. The method of embodiment 83, wherein the method comprises separating the AAV-purification matrix complex from one or more impurities.

85. The method of embodiment 84, wherein the AAV-purification matrix complex is separated from the one or more impurities by washing the AAV-purification matrix complex.

86. The method of any one of embodiments 83-85, wherein the method comprises eluting the AAV from the AAV-purification matrix complex.

87. The method of embodiment 86, wherein the AAV is eluted from the AAV-purification matrix complex by changing the pH of a composition comprising the AAV-purification matrix complex.

88. The method of embodiment 86, wherein the AAV is eluted from the AAV-purification matrix complex by changing the temperature of a composition comprising the AAV-purification matrix complex.

89. The method of embodiment 86, wherein the AAV is eluted from the AAV-purification matrix complex by changing the ionic strength of a composition comprising the AAV-purification matrix complex.

90. The method of embodiment 86, wherein the AAV is eluted from the AAV-purification matrix complex by the addition of a reducing agent to a composition comprising the AAV-purification matrix complex.

91. A method for purifying an AAV, the method comprising contacting the AAV with the purification matrix of any one of embodiments 36-78.

92. The method of embodiment 91, wherein the AAV comprises a wildtype AAV capsid.

93. The method of embodiment 91, wherein the AAV comprises a mutant AAV capsid.

94. The method of embodiment 91, wherein the AAV comprises a capsid of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV.

95. The method of any one of embodiments 91-94, wherein the AAV reversibly binds to the purification matrix to form an AAV-purification matrix complex.

96. The method of embodiment 95, wherein the method comprises using a first environmental factor to increase the size of the AAV-purification matrix complex.

97. The method of embodiment 96, wherein the first environmental factor comprises one or more of:
   a. a change in one or more of temperature, pH, salt concentration or pressure;
   b. the addition of one or more surfactants, cofactors, vitamins, molecular crowding agents, enzymes, denaturing agents; or
   c. the application of electromagnetic or acoustic waves.

98. The method of embodiment 96 or 97, wherein the method comprises separating the AAV-purification matrix complex from at least one impurity on the basis of size.

99. The method of embodiment 98, wherein the AAV-purification matrix complex is separated from at least one impurity on the basis of diameter.

100. The method of embodiment 98, wherein the AAV-purification matrix complex is separated from at least one impurity on the basis of mass.

101. The method of any one of embodiments 98-100, wherein the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

102. The method of any one of embodiments 91-101, wherein a second environmental factor is used to elute the AAV from the AAV-purification matrix complex.

103. The method of embodiment 102, wherein the second environmental factor comprises one or more of:
   a. a change in one or more of temperature, pH, salt concentration or pressure;
   b. the addition of one or more surfactants, cofactors, vitamins, molecular crowding agents, denaturing agents, enzymes; or
   c. the application of electromagnetic or acoustic waves.

104. The method of any one of embodiments 79-103, comprising regenerating the purification matrix and reusing the purification matrix to purify a second AAV.

105. The method of any one of embodiments 79-103, wherein the purified AAV has a level of infectivity that is greater than 95% of the level of infectivity before purification.

106. The method of any one of embodiments 79-103, wherein the AAV retains at least 96% of its infectivity after purification.

107. The method of any one of embodiments 79-103, wherein the AAV retains at least 97% of its infectivity after purification.

108. The method of any one of embodiments 79-103, wherein the AAV retains at least 98% of its infectivity after purification.

109. The method of any one of embodiments 79-103, wherein the AAV retains at least 99% of its infectivity after purification.

110. The method of any one of embodiments 79-103, wherein the AAV retains at least 100% of its infectivity after purification.

111. The method of any one of embodiments 79-103, wherein the purified AAV is enriched for full capsids.

112. The method of embodiment 111, wherein the purified AAV has an increased qPCR: ELISA ratio as compared to the qPCR:ELISA ratio before purification.

113. The method of any one of embodiments 79-112, wherein the method is completed in about 2 to about 10 hours.

114. The method of embodiment 113, wherein the method is completed in about 4 to about 8 hours.

115. A composition comprising an AAV purified according to the method of any one of embodiments 79-114.

116. The composition of embodiment 115, wherein the composition is at least 70%, at least 80%, at least 85%, at least 90%, at least 95%, at least 96%, at least 97%, at least 98%, or at least 99% free of impurities.

117. An AAV binding polypeptide comprising the sequence of any one of SEQ ID NOS: 28-47 with at least one mutation.

118. A nucleic acid encoding the AAV binding polypeptide of embodiment 117.

119. A vector comprising the nucleic acid of embodiment 118.

120. A composition comprising the AAV binding polypeptide of embodiment 117, the nucleic acid of embodiment 118, or the vector of embodiment 119.

121. A kit comprising the AAV binding polypeptide of embodiment 117, the nucleic acid of embodiment 118, or the vector of embodiment 119.

122. A method of increasing yield of AAV particles during production thereof, the method comprising culturing AAV-producing cells in the presence of a purification matrix.

123. A method of stabilizing AAV particles during production thereof, the method comprising culturing AAV-producing cells in the presence of a purification matrix.

124. A method of stabilizing AAV particles during purification thereof, the method comprising contacting the AAV particles with a purification matrix during purification thereof.

125. A method of stabilizing AAV particles during storage thereof, the method comprising storing the AAV particles in the presence of a purification matrix.

126. A method of increasing the shelf-life of AAV particles, the method comprising storing the AAV particles in the presence of a purification matrix.

127. The method of any one of embodiments 122-126, wherein the purification matrix is the purification matrix of any one of embodiments 1-78.

128. The method of any one of embodiments 122-127, wherein the AAV particles are wildtype AAV particles of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV.

129. The method of any one of embodiments 122-127, wherein the AAV particles are mutant AAV particles.

130. The method of any one of embodiments 122-127, wherein the AAV particles reversibly bind to the purification matrix to form an AAV-purification matrix complex.

131. The method of any one of embodiments 122-127, wherein the purification matrix is present at a concentration of at least about 10 μM.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that it constitutes valid prior art or form part of the common general knowledge in any country in the world.

SEQUENCE LISTING (175 sequences)

SEQ ID NO: 1 - protein, 3500 aa, Artificial Sequence
  resilin-like polypeptide
  VARIANT (8)..(3500): May be present or absent in groups of the repeat unit Gly Arg Gly Asp Ser Pro Tyr
GRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPY

SEQ ID NO: 2 - protein, 3500 aa, Artificial Sequence
  resilin-like polypeptide
  VARIANT (8)..(3500): May be present or absent in groups of the repeat unit Gly Arg Gly Asp Ser Pro His
GRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPH

SEQ ID NO: 3 - protein, 3500 aa, Artificial Sequence
  resilin-like polypeptide
  VARIANT (8)..(3500): May be present or absent in groups of the repeat unit Gly Arg Gly Asp Ser Pro Val
GRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPV

SEQ ID NO: 4 - protein, 4000 aa, Artificial Sequence
  resilin-like polypeptide
  VARIANT (9)..(4000): May be present or absent in groups of the repeat unit Gly Arg Gly Asp Ser Pro Tyr Gly
GRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYG

SEQ ID NO: 5 - protein, 3500 aa, Artificial Sequence
  resilin-like polypeptide
  VARIANT (8)..(3500): May be present or absent in groups of the repeat unit Arg Pro Leu Gly Tyr Asp Ser
RPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDS

SEQ ID NO: 6 - protein, 3500 aa, Artificial Sequence
  resilin-like polypeptide
  VARIANT (8)..(3500): May be present or absent in groups of the repeat unit Arg Pro Ala Gly Tyr Asp Ser
RPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDS

SEQ ID NO: 7 - protein, 3500 aa, Artificial Sequence
  resilin-like polypeptide
  VARIANT (8)..(3500): May be present or absent in groups of the repeat unit Gly Arg Gly Asp Ser Tyr Pro
GRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYP

SEQ ID NO: 8 - protein, 4000 aa, Artificial Sequence
  resilin-like polypeptide
  VARIANT (9)..(4000): May be present or absent in groups of the repeat unit Gly Arg Gly Asp Ser Pro Tyr Gln
GRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQ

SEQ ID NO: 9 - protein, 4000 aa, Artificial Sequence
  resilin-like polypeptide
  VARIANT (9)..(4000): May be present or absent in groups of the repeat unit Gly Arg Gly Asn Ser Pro Tyr Gly
GRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYG

SEQ ID NO: 10 - protein, 2500 aa, Artificial Sequence
  elastin-like polypeptide
  VARIANT (4)..(4): Xaa can be any naturally occurring amino acid
  VARIANT (6)..(2500): May be present or absent in groups of the repeat unit Val Pro Gly Xaa Gly
  VARIANT (9)..(9): Xaa can be any naturally occurring amino acid
  VARIANT (14)..(14): Xaa can be any naturally occurring amino acid
  VARIANT (19)..(19): Xaa can be any naturally occurring amino acid
  VARIANT (24)..(24): Xaa can be any naturally occurring amino acid
  VARIANT (29)..(29): Xaa can be any naturally occurring amino acid
  VARIANT (34)..(34): Xaa can be any naturally occurring amino acid
  VARIANT (39)..(39): Xaa can be any naturally occurring amino acid
  VARIANT (44)..(44): Xaa can be any naturally occurring amino acid
  VARIANT (49)..(49): Xaa can be any naturally occurring amino acid
  VARIANT (54)..(54): Xaa can be any naturally occurring amino acid
  VARIANT (59)..(59): Xaa can be any naturally occurring amino acid
  VARIANT (64)..(64): Xaa can be any naturally occurring amino acid
  VARIANT (69)..(69): Xaa can be any naturally occurring amino acid
  VARIANT (74)..(74): Xaa can be any naturally occurring amino acid
  VARIANT (79)..(79): Xaa can be any naturally occurring amino acid
  VARIANT (84)..(84): Xaa can be any naturally occurring amino acid
  VARIANT (89)..(89): Xaa can be any naturally occurring amino acid
  VARIANT (94)..(94): Xaa can be any naturally occurring amino acid
  VARIANT (99)..(99): Xaa can be any naturally occurring amino acid
  VARIANT (104)..(104): Xaa can be any naturally occurring amino acid
  VARIANT (109)..(109): Xaa can be any naturally occurring amino acid
  VARIANT (114)..(114): Xaa can be any naturally occurring amino acid
  VARIANT (119)..(119): Xaa can be any naturally occurring amino acid
  VARIANT (124)..(124): Xaa can be any naturally occurring amino acid
  VARIANT (129)..(129): Xaa can be any naturally occurring amino acid
  VARIANT (134)..(134): Xaa can be any naturally occurring amino acid
  VARIANT (139)..(139): Xaa can be any naturally occurring amino acid
  VARIANT (144)..(144): Xaa can be any naturally occurring amino acid
  VARIANT (149)..(149): Xaa can be any naturally occurring amino acid
  VARIANT (154)..(154): Xaa can be any naturally occurring amino acid
  VARIANT (159)..(159): Xaa can be any naturally occurring amino acid
  VARIANT (164)..(164): Xaa can be any naturally occurring amino acid
  VARIANT (169)..(169): Xaa can be any naturally occurring amino acid
  VARIANT (174)..(174): Xaa can be any naturally occurring amino acid
  VARIANT (179)..(179): Xaa can be any naturally occurring amino acid
  VARIANT (184)..(184): Xaa can be any naturally occurring amino acid
  VARIANT (189)..(189): Xaa can be any naturally occurring amino acid
  VARIANT (194)..(194): Xaa can be any naturally occurring amino acid
  VARIANT (199)..(199): Xaa can be any naturally occurring amino acid
  VARIANT (204)..(204): Xaa can be any naturally occurring amino acid
  VARIANT (209)..(209): Xaa can be any naturally occurring amino acid
  VARIANT (214)..(214): Xaa can be any naturally occurring amino acid
  VARIANT (219)..(219): Xaa can be any naturally occurring amino acid
  VARIANT (224)..(224): Xaa can be any naturally occurring amino acid
  VARIANT (229)..(229): Xaa can be any naturally occurring amino acid
  VARIANT (234)..(234): Xaa can be any naturally occurring amino acid
  VARIANT (239)..(239): Xaa can be any naturally occurring amino acid
  VARIANT (244)..(244): Xaa can be any naturally occurring amino acid
  VARIANT (249)..(249): Xaa can be any naturally occurring amino acid
  VARIANT (254)..(254): Xaa can be any naturally occurring amino acid
  VARIANT (259)..(259): Xaa can be any naturally occurring amino acid
  VARIANT (264)..(264): Xaa can be any naturally occurring amino acid
  VARIANT (269)..(269): Xaa can be any naturally occurring amino acid
  VARIANT (274)..(274): Xaa can be any naturally occurring amino acid
  VARIANT (279)..(279): Xaa can be any naturally occurring amino acid
  VARIANT (284)..(284): Xaa can be any naturally occurring amino acid
  VARIANT (289)..(289): Xaa can be any naturally occurring amino acid
  VARIANT (294)..(294): Xaa can be any naturally occurring amino acid
  VARIANT (299)..(299): Xaa can be any naturally occurring amino acid
  VARIANT (304)..(304): Xaa can be any naturally occurring amino acid
  VARIANT (309)..(309): Xaa can be any naturally occurring amino acid
  VARIANT (314)..(314): Xaa can be any naturally occurring amino acid
  VARIANT (319)..(319): Xaa can be any naturally occurring amino acid
  VARIANT (324)..(324): Xaa can be any naturally occurring amino acid
  VARIANT (329)..(329): Xaa can be any naturally occurring amino acid
  VARIANT (334)..(334): Xaa can be any naturally occurring amino acid
  VARIANT (339)..(339): Xaa can be any naturally occurring amino acid
  VARIANT (344)..(344): Xaa can be any naturally occurring amino acid
  VARIANT (349)..(349): Xaa can be any naturally occurring amino acid
  VARIANT (354)..(354): Xaa can be any naturally occurring amino acid
  VARIANT (359)..(359): Xaa can be any naturally occurring amino acid
  VARIANT (364)..(364): Xaa can be any naturally occurring amino acid
  VARIANT (369)..(369): Xaa can be any naturally occurring amino acid
  VARIANT (374)..(374): Xaa can be any naturally occurring amino acid
  VARIANT (379)..(379): Xaa can be any naturally occurring amino acid
  VARIANT (384)..(384): Xaa can be any naturally occurring amino acid
  VARIANT (389)..(389): Xaa can be any naturally occurring amino acid
  VARIANT (394)..(394): Xaa can be any naturally occurring amino acid
  VARIANT (399)..(399): Xaa can be any naturally occurring amino acid
  VARIANT (404)..(404): Xaa can be any naturally occurring amino acid
  VARIANT (409)..(409): Xaa can be any naturally occurring amino acid
  VARIANT (414)..(414): Xaa can be any naturally occurring amino acid
  VARIANT (419)..(419): Xaa can be any naturally occurring amino acid
  VARIANT (424)..(424): Xaa can be any naturally occurring amino acid
  VARIANT (429)..(429): Xaa can be any naturally occurring amino acid
  VARIANT (434)..(434): Xaa can be any naturally occurring amino acid
  VARIANT (439)..(439): Xaa can be any naturally occurring amino acid
  VARIANT (444)..(444): Xaa can be any naturally occurring amino acid
  VARIANT (449)..(449): Xaa can be any naturally occurring amino acid
  VARIANT (454)..(454): Xaa can be any naturally occurring amino acid
  VARIANT (459)..(459): Xaa can be any naturally occurring amino acid
  VARIANT (464)..(464): Xaa can be any naturally occurring amino acid
  VARIANT (469)..(469): Xaa can be any naturally occurring amino acid
  VARIANT (474)..(474): Xaa can be any naturally occurring amino acid
  VARIANT (479)..(479): Xaa can be any naturally occurring amino acid
  VARIANT (484)..(484): Xaa can be any naturally occurring amino acid
  VARIANT (489)..(489): Xaa can be any naturally occurring amino acid
  VARIANT (494)..(494): Xaa can be any naturally occurring amino acid
  VARIANT (499)..(499): Xaa can be any naturally occurring amino acid
  VARIANT (504)..(504): Xaa can be any naturally occurring amino acid
  VARIANT (509)..(509): Xaa can be any naturally occurring amino acid
  VARIANT (514)..(514): Xaa can be any naturally occurring amino acid
  VARIANT (519)..(519): Xaa can be any naturally occurring amino acid
  VARIANT (524)..(524): Xaa can be any naturally occurring amino acid
  VARIANT (529)..(529): Xaa can be any naturally occurring amino acid
  VARIANT (534)..(534): Xaa can be any naturally occurring amino acid
  VARIANT (539)..(539): Xaa can be any naturally occurring amino acid
  VARIANT (544)..(544): Xaa can be any naturally occurring amino acid
  VARIANT (549)..(549): Xaa can be any naturally occurring amino acid
  VARIANT (554)..(554): Xaa can be any naturally occurring amino acid
  VARIANT (559)..(559): Xaa can be any naturally occurring amino acid
  VARIANT (564)..(564): Xaa can be any naturally occurring amino acid
  VARIANT (569)..(569): Xaa can be any naturally occurring amino acid
  VARIANT (574)..(574): Xaa can be any naturally occurring amino acid
  VARIANT (579)..(579): Xaa can be any naturally occurring amino acid
  VARIANT (584)..(584): Xaa can be any naturally occurring amino acid
  VARIANT (589)..(589): Xaa can be any naturally occurring amino acid
  VARIANT (594)..(594): Xaa can be any naturally occurring amino acid
  VARIANT (599)..(599): Xaa can be any naturally occurring amino acid
  VARIANT (604)..(604): Xaa can be any naturally occurring amino acid
  VARIANT (609)..(609): Xaa can be any naturally occurring amino acid
  VARIANT (614)..(614): Xaa can be any naturally occurring amino acid
  VARIANT (619)..(619): Xaa can be any naturally occurring amino acid
  VARIANT (624)..(624): Xaa can be any naturally occurring amino acid
  VARIANT (629)..(629): Xaa can be any naturally occurring amino acid
  VARIANT (634)..(634): Xaa can be any naturally occurring amino acid
  VARIANT (639)..(639): Xaa can be any naturally occurring amino acid
  VARIANT (644)..(644): Xaa can be any naturally occurring amino acid
  VARIANT (649)..(649): Xaa can be any naturally occurring amino acid
  VARIANT (654)..(654): Xaa can be any naturally occurring amino acid
  VARIANT (659)..(659): Xaa can be any naturally occurring amino acid
  VARIANT (664)..(664): Xaa can be any naturally occurring amino acid
  VARIANT (669)..(669): Xaa can be any naturally occurring amino acid
  VARIANT (674)..(674): Xaa can be any naturally occurring amino acid
  VARIANT (679)..(679): Xaa can be any naturally occurring amino acid
  VARIANT (684)..(684): Xaa can be any naturally occurring amino acid
  VARIANT (689)..(689): Xaa can be any naturally occurring amino acid
  VARIANT (694)..(694): Xaa can be any naturally occurring amino acid
  VARIANT (699)..(699): Xaa can be any naturally occurring amino acid
  VARIANT (704)..(704): Xaa can be any naturally occurring amino acid
  VARIANT (709)..(709): Xaa can be any naturally occurring amino acid
  VARIANT (714)..(714): Xaa can be any naturally occurring amino acid
  VARIANT (719)..(719): Xaa can be any naturally occurring amino acid
  VARIANT (724)..(724): Xaa can be any naturally occurring amino acid
  VARIANT (729)..(729): Xaa can be any naturally occurring amino acid
  VARIANT (734)..(734): Xaa can be any naturally occurring amino acid
  VARIANT (739)..(739): Xaa can be any naturally occurring amino acid
  VARIANT (744)..(744): Xaa can be any naturally occurring amino acid
  VARIANT (749)..(749): Xaa can be any naturally occurring amino acid
  VARIANT (754)..(754): Xaa can be any naturally occurring amino acid
  VARIANT (759)..(759): Xaa can be any naturally occurring amino acid
  VARIANT (764)..(764): Xaa can be any naturally occurring amino acid
  VARIANT (769)..(769): Xaa can be any naturally occurring amino acid
  VARIANT (774)..(774): Xaa can be any naturally occurring amino acid
  VARIANT (779)..(779): Xaa can be any naturally occurring amino acid
  VARIANT (784)..(784): Xaa can be any naturally occurring amino acid
  VARIANT (789)..(789): Xaa can be any naturally occurring amino acid
  VARIANT (794)..(794): Xaa can be any naturally occurring amino acid
  VARIANT (799)..(799): Xaa can be any naturally occurring amino acid
  VARIANT (804)..(804): Xaa can be any naturally occurring amino acid
  VARIANT (809)..(809): Xaa can be any naturally occurring amino acid
  VARIANT (814)..(814): Xaa can be any naturally occurring amino acid
  VARIANT (819)..(819): Xaa can be any naturally occurring amino acid
  VARIANT (824)..(824): Xaa can be any naturally occurring amino acid
  VARIANT (829)..(829): Xaa can be any naturally occurring amino acid
  VARIANT (834)..(834): Xaa can be any naturally occurring amino acid
  VARIANT (839)..(839): Xaa can be any naturally occurring amino acid
  VARIANT (844)..(844): Xaa can be any naturally occurring amino acid
  VARIANT (849)..(849): Xaa can be any naturally occurring amino acid
  VARIANT (854)..(854): Xaa can be any naturally occurring amino acid
  VARIANT (859)..(859): Xaa can be any naturally occurring amino acid
  VARIANT (864)..(864): Xaa can be any naturally occurring amino acid
  VARIANT (869)..(869): Xaa can be any naturally occurring amino acid
  VARIANT (874)..(874): Xaa can be any naturally occurring amino acid
  VARIANT (879)..(879): Xaa can be any naturally occurring amino acid
  VARIANT (884)..(884): Xaa can be any naturally occurring amino acid
  VARIANT (889)..(889): Xaa can be any naturally occurring amino acid
  VARIANT (894)..(894): Xaa can be any naturally occurring amino acid
  VARIANT (899)..(899): Xaa can be any naturally occurring amino acid
  VARIANT (904)..(904): Xaa can be any naturally occurring amino acid
  VARIANT (909)..(909): Xaa can be any naturally occurring amino acid
  VARIANT (914)..(914): Xaa can be any naturally occurring amino acid
  VARIANT (919)..(919): Xaa can be any naturally occurring amino acid
  VARIANT (924)..(924): Xaa can be any naturally occurring amino acid
  VARIANT (929)..(929): Xaa can be any naturally occurring amino acid
  VARIANT (934)..(934): Xaa can be any naturally occurring amino acid
  VARIANT (939)..(939): Xaa can be any naturally occurring amino acid
  VARIANT (944)..(944): Xaa can be any naturally occurring amino acid
  VARIANT (949)..(949): Xaa can be any naturally occurring amino acid
  VARIANT (954)..(954): Xaa can be any naturally occurring amino acid
  VARIANT (959)..(959): Xaa can be any naturally occurring amino acid
  VARIANT (964)..(964): Xaa can be any naturally occurring amino acid
  VARIANT (969)..(969): Xaa can be any naturally occurring amino acid
  VARIANT (974)..(974): Xaa can be any naturally occurring amino acid
  VARIANT (979)..(979): Xaa can be any naturally occurring amino acid
  VARIANT (984)..(984): Xaa can be any naturally occurring amino acid
  VARIANT (989)..(989): Xaa can be any naturally occurring amino acid
  VARIANT (994)..(994): Xaa can be any naturally occurring amino acid
  VARIANT (999)..(999): Xaa can be any naturally occurring amino acid
  VARIANT (1004)..(1004): Xaa can be any naturally occurring amino acid
  VARIANT (1009)..(1009): Xaa can be any naturally occurring amino acid
  VARIANT (1014)..(1014): Xaa can be any naturally occurring amino acid
  VARIANT (1019)..(1019): Xaa can be any naturally occurring amino acid
  VARIANT (1024)..(1024): Xaa can be any naturally occurring amino acid
  VARIANT (1029)..(1029): Xaa can be any naturally occurring amino acid
  VARIANT (1034)..(1034): Xaa can be any naturally occurring amino acid
  VARIANT (1039)..(1039): Xaa can be any naturally occurring amino acid
  VARIANT (1044)..(1044): Xaa can be any naturally occurring amino acid
  VARIANT (1049)..(1049): Xaa can be any naturally occurring amino acid
  VARIANT (1054)..(1054): Xaa can be any naturally occurring amino acid
  VARIANT (1059)..(1059): Xaa can be any naturally occurring amino acid
  VARIANT (1064)..(1064): Xaa can be any naturally occurring amino acid
  VARIANT (1069)..(1069): Xaa can be any naturally occurring amino acid
  VARIANT (1074)..(1074): Xaa can be any naturally occurring amino acid
  VARIANT (1079)..(1079): Xaa can be any naturally occurring amino acid
  VARIANT (1084)..(1084): Xaa can be any naturally occurring amino acid
  VARIANT (1089)..(1089): Xaa can be any naturally occurring amino acid
  VARIANT (1094)..(1094): Xaa can be any naturally occurring amino acid
  VARIANT (1099)..(1099): Xaa can be any naturally occurring amino acid
  VARIANT (1104)..(1104): Xaa can be any naturally occurring amino acid
  VARIANT (1109)..(1109): Xaa can be any naturally occurring amino acid
  VARIANT (1114)..(1114): Xaa can be any naturally occurring amino acid
  VARIANT (1119)..(1119): Xaa can be any naturally occurring amino acid
  VARIANT (1124)..(1124): Xaa can be any naturally occurring amino acid
  VARIANT (1129)..(1129): Xaa can be any naturally occurring amino acid
  VARIANT (1134)..(1134): Xaa can be any naturally occurring amino acid
  VARIANT (1139)..(1139): Xaa can be any naturally occurring amino acid
  VARIANT (1144)..(1144): Xaa can be any naturally occurring amino acid
  VARIANT (1149)..(1149): Xaa can be any naturally occurring amino acid
  VARIANT (1154)..(1154): Xaa can be any naturally occurring amino acid
  VARIANT (1159)..(1159): Xaa can be any naturally occurring amino acid
  VARIANT (1164)..(1164): Xaa can be any naturally occurring amino acid
  VARIANT (1169)..(1169): Xaa can be any naturally occurring amino acid
  VARIANT (1174)..(1174): Xaa can be any naturally occurring amino acid
  VARIANT (1179)..(1179): Xaa can be any naturally occurring amino acid
  VARIANT (1184)..(1184): Xaa can be any naturally occurring amino acid
  VARIANT (1189)..(1189): Xaa can be any naturally occurring amino acid
  VARIANT (1194)..(1194): Xaa can be any naturally occurring amino acid
  VARIANT (1199)..(1199): Xaa can be any naturally occurring amino acid
  VARIANT (1204)..(1204): Xaa can be any naturally occurring amino acid
  VARIANT (1209)..(1209): Xaa can be any naturally occurring amino acid
  VARIANT (1214)..(1214): Xaa can be any naturally occurring amino acid
  VARIANT (1219)..(1219): Xaa can be any naturally occurring amino acid
  VARIANT (1224)..(1224): Xaa can be any naturally occurring amino acid
  VARIANT (1229)..(1229): Xaa can be any naturally occurring amino acid
  VARIANT (1234)..(1234): Xaa can be any naturally occurring amino acid
  VARIANT (1239)..(1239): Xaa can be any naturally occurring amino acid
  VARIANT (1244)..(1244): Xaa can be any naturally occurring amino acid
  VARIANT (1249)..(1249): Xaa can be any naturally occurring amino acid
  VARIANT (1254)..(1254): Xaa can be any naturally occurring amino acid
  VARIANT (1259)..(1259): Xaa can be any naturally occurring amino acid
  VARIANT (1264)..(1264): Xaa can be any naturally occurring amino acid
  VARIANT (1269)..(1269): Xaa can be any naturally occurring amino acid
  VARIANT (1274)..(1274): Xaa can be any naturally occurring amino acid
  VARIANT (1279)..(1279): Xaa can be any naturally occurring amino acid
  VARIANT (1284)..(1284): Xaa can be any naturally occurring amino acid
  VARIANT (1289)..(1289): Xaa can be any naturally occurring amino acid
  VARIANT (1294)..(1294): Xaa can be any naturally occurring amino acid
  VARIANT (1299)..(1299): Xaa can be any naturally occurring amino acid
  VARIANT (1304)..(1304): Xaa can be any naturally occurring amino acid
  VARIANT (1309)..(1309): Xaa can be any naturally occurring amino acid
  VARIANT (1314)..(1314): Xaa can be any naturally occurring amino acid
  VARIANT (1319)..(1319): Xaa can be any naturally occurring amino acid
  VARIANT (1324)..(1324): Xaa can be any naturally occurring amino acid
  VARIANT (1329)..(1329): Xaa can be any naturally occurring amino acid
  VARIANT (1334)..(1334): Xaa can be any naturally occurring amino acid
  VARIANT (1339)..(1339): Xaa can be any naturally occurring amino acid
  VARIANT (1344)..(1344): Xaa can be any naturally occurring amino acid
  VARIANT (1349)..(1349): Xaa can be any naturally occurring amino acid
  VARIANT (1354)..(1354): Xaa can be any naturally occurring amino acid
  VARIANT (1359)..(1359): Xaa can be any naturally occurring amino acid
  VARIANT (1364)..(1364): Xaa can be any naturally occurring amino acid
  VARIANT (1369)..(1369): Xaa can be any naturally occurring amino acid
  VARIANT (1374)..(1374): Xaa can be any naturally occurring amino acid
  VARIANT (1379)..(1379): Xaa can be any naturally occurring amino acid
  VARIANT (1384)..(1384): Xaa can be any naturally occurring amino acid
  VARIANT (1389)..(1389): Xaa can be any naturally occurring amino acid
  VARIANT (1394)..(1394): Xaa can be any naturally occurring amino acid
  VARIANT (1399)..(1399): Xaa can be any naturally occurring amino acid
  VARIANT (1404)..(1404): Xaa can be any naturally occurring amino acid
  VARIANT (1409)..(1409): Xaa can be any naturally occurring amino acid
  VARIANT (1414)..(1414): Xaa can be any naturally occurring amino acid
  VARIANT (1419)..(1419): Xaa can be any naturally occurring amino acid
  VARIANT (1424)..(1424): Xaa can be any naturally occurring amino acid
  VARIANT (1429)..(1429): Xaa can be any naturally occurring amino acid
  VARIANT (1434)..(1434): Xaa can be any naturally occurring amino acid
  VARIANT (1439)..(1439): Xaa can be any naturally occurring amino acid
  VARIANT (1444)..(1444): Xaa can be any naturally occurring amino acid
  VARIANT (1449)..(1449): Xaa can be any naturally occurring amino acid
  VARIANT (1454)..(1454): Xaa can be any naturally occurring amino acid
  VARIANT (1459)..(1459): Xaa can be any naturally occurring amino acid
  VARIANT (1464)..(1464): Xaa can be any naturally occurring amino acid
  VARIANT (1469)..(1469): Xaa can be any naturally occurring amino acid
  VARIANT (1474)..(1474): Xaa can be any naturally occurring amino acid
  VARIANT (1479)..(1479): Xaa can be any naturally occurring amino acid
  VARIANT (1484)..(1484): Xaa can be any naturally occurring amino acid
  VARIANT (1489)..(1489): Xaa can be any naturally occurring amino acid
  VARIANT (1494)..(1494): Xaa can be any naturally occurring amino acid
  VARIANT (1499)..(1499): Xaa can be any naturally occurring amino acid
  VARIANT (1504)..(1504): Xaa can be any naturally occurring amino acid
  VARIANT (1509)..(1509): Xaa can be any naturally occurring amino acid
  VARIANT (1514)..(1514): Xaa can be any naturally occurring amino acid
  VARIANT (1519)..(1519): Xaa can be any naturally occurring amino acid
  VARIANT (1524)..(1524): Xaa can be any naturally occurring amino acid
  VARIANT (1529)..(1529): Xaa can be any naturally occurring amino acid
  VARIANT (1534)..(1534): Xaa can be any naturally occurring amino acid
  VARIANT (1539)..(1539): Xaa can be any naturally occurring amino acid
  VARIANT (1544)..(1544): Xaa can be any naturally occurring amino acid
  VARIANT (1549)..(1549): Xaa can be any naturally occurring amino acid
  VARIANT (1554)..(1554): Xaa can be any naturally occurring amino acid
  VARIANT (1559)..(1559): Xaa can be any naturally occurring amino acid
  VARIANT (1564)..(1564): Xaa can be any naturally occurring amino acid
  VARIANT (1569)..(1569): Xaa can be any naturally occurring amino acid
  VARIANT (1574)..(1574): Xaa can be any naturally occurring amino acid
  VARIANT (1579)..(1579): Xaa can be any naturally occurring amino acid
  VARIANT (1584)..(1584): Xaa can be any naturally occurring amino acid
  VARIANT (1589)..(1589): Xaa can be any naturally occurring amino acid
  VARIANT (1594)..(1594): Xaa can be any naturally occurring amino acid
  VARIANT (1599)..(1599): Xaa can be any naturally occurring amino acid
  VARIANT (1604)..(1604): Xaa can be any naturally occurring amino acid
  VARIANT (1609)..(1609): Xaa can be any naturally occurring amino acid
  VARIANT (1614)..(1614): Xaa can be any naturally occurring amino acid
  VARIANT (1619)..(1619): Xaa can be any naturally occurring amino acid
  VARIANT (1624)..(1624): Xaa can be any naturally occurring amino acid
  VARIANT (1629)..(1629): Xaa can be any naturally occurring amino acid
  VARIANT (1634)..(1634): Xaa can be any naturally occurring amino acid
  VARIANT (1639)..(1639): Xaa can be any naturally occurring amino acid
  VARIANT (1644)..(1644): Xaa can be any naturally occurring amino acid
  VARIANT (1649)..(1649): Xaa can be any naturally occurring amino acid
  VARIANT (1654)..(1654): Xaa can be any naturally occurring amino acid
  VARIANT (1659)..(1659): Xaa can be any naturally occurring amino acid
  VARIANT (1664)..(1664): Xaa can be any naturally occurring amino acid
  VARIANT (1669)..(1669): Xaa can be any naturally occurring amino acid
  VARIANT (1674)..(1674): Xaa can be any naturally occurring amino acid
  VARIANT (1679)..(1679): Xaa can be any naturally occurring amino acid
  VARIANT (1684)..(1684): Xaa can be any naturally occurring amino acid
  VARIANT (1689)..(1689): Xaa can be any naturally occurring amino acid
  VARIANT (1694)..(1694): Xaa can be any naturally occurring amino acid
  VARIANT (1699)..(1699): Xaa can be any naturally occurring amino acid
  VARIANT (1704)..(1704): Xaa can be any naturally occurring amino acid
  VARIANT (1709)..(1709): Xaa can be any naturally occurring amino acid
  VARIANT (1714)..(1714): Xaa can be any naturally occurring amino acid
  VARIANT (1719)..(1719): Xaa can be any naturally occurring amino acid
  VARIANT (1724)..(1724): Xaa can be any naturally occurring amino acid
  VARIANT (1729)..(1729): Xaa can be any naturally occurring amino acid
  VARIANT (1734)..(1734): Xaa can be any naturally occurring amino acid
  VARIANT (1739)..(1739): Xaa can be any naturally occurring amino acid
  VARIANT (1744)..(1744): Xaa can be any naturally occurring amino acid
  VARIANT (1749)..(1749): Xaa can be any naturally occurring amino acid
  VARIANT (1754)..(1754): Xaa can be any naturally occurring amino acid
  VARIANT (1759)..(1759): Xaa can be any naturally occurring amino acid
  VARIANT (1764)..(1764): Xaa can be any naturally occurring amino acid
  VARIANT (1769)..(1769): Xaa can be any naturally occurring amino acid
  VARIANT (1774)..(1774): Xaa can be any naturally occurring amino acid
  VARIANT (1779)..(1779): Xaa can be any naturally occurring amino acid
  VARIANT (1784)..(1784): Xaa can be any naturally occurring amino acid
  VARIANT (1789)..(1789): Xaa can be any naturally occurring amino acid
  VARIANT (1794)..(1794): Xaa can be any naturally occurring amino acid
  VARIANT (1799)..(1799): Xaa can be any naturally occurring amino acid
  VARIANT (1804)..(1804): Xaa can be any naturally occurring amino acid
  VARIANT (1809)..(1809): Xaa can be any naturally occurring amino acid
  VARIANT (1814)..(1814): Xaa can be any naturally occurring amino acid
  VARIANT (1819)..(1819): Xaa can be any naturally occurring amino acid
  VARIANT (1824)..(1824): Xaa can be any naturally occurring amino acid
  VARIANT (1829)..(1829): Xaa can be any naturally occurring amino acid
  VARIANT (1834)..(1834): Xaa can be any naturally occurring amino acid
  VARIANT (1839)..(1839): Xaa can be any naturally occurring amino acid
  VARIANT (1844)..(1844): Xaa can be any naturally occurring amino acid
  VARIANT (1849)..(1849): Xaa can be any naturally occurring amino acid
  VARIANT (1854)..(1854): Xaa can be any naturally occurring amino acid
  VARIANT (1859)..(1859): Xaa can be any naturally occurring amino acid
  VARIANT (1864)..(1864): Xaa can be any naturally occurring amino acid
  VARIANT (1869)..(1869): Xaa can be any naturally occurring amino acid
  VARIANT (1874)..(1874): Xaa can be any naturally occurring amino acid
  VARIANT (1879)..(1879): Xaa can be any naturally occurring amino acid
  VARIANT (1884)..(1884): Xaa can be any naturally occurring amino acid
  VARIANT (1889)..(1889): Xaa can be any naturally occurring amino acid
  VARIANT (1894)..(1894): Xaa can be any naturally occurring amino acid
  VARIANT (1899)..(1899): Xaa can be any naturally occurring amino acid
  VARIANT (1904)..(1904): Xaa can be any naturally occurring amino acid
  VARIANT (1909)..(1909): Xaa can be any naturally occurring amino acid
  VARIANT (1914)..(1914): Xaa can be any naturally occurring amino acid
  VARIANT (1919)..(1919): Xaa can be any naturally occurring amino acid
  VARIANT (1924)..(1924): Xaa can be any naturally occurring amino acid
  VARIANT (1929)..(1929): Xaa can be any naturally occurring amino acid
  VARIANT (1934)..(1934): Xaa can be any naturally occurring amino acid
  VARIANT (1939)..(1939): Xaa can be any naturally occurring amino acid
  VARIANT (1944)..(1944): Xaa can be any naturally occurring amino acid
  VARIANT (1949)..(1949): Xaa can be any naturally occurring amino acid
  VARIANT (1954)..(1954): Xaa can be any naturally occurring amino acid
  VARIANT (1959)..(1959): Xaa can be any naturally occurring amino acid
  VARIANT (1964)..(1964): Xaa can be any naturally occurring amino acid
  VARIANT (1969)..(1969): Xaa can be any naturally occurring amino acid
  VARIANT (1974)..(1974): Xaa can be any naturally occurring amino acid
  VARIANT (1979)..(1979): Xaa can be any naturally occurring amino acid
  VARIANT (1984)..(1984): Xaa can be any naturally occurring amino acid
  VARIANT (1989)..(1989): Xaa can be any naturally occurring amino acid
  VARIANT (1994)..(1994): Xaa can be any naturally occurring amino acid
  VARIANT (1999)..(1999): Xaa can be any naturally occurring amino acid
  VARIANT (2004)..(2004): Xaa can be any naturally occurring amino acid
  VARIANT (2009)..(2009): Xaa can be any naturally occurring amino acid
  VARIANT (2014)..(2014): Xaa can be any naturally occurring amino acid
  VARIANT (2019)..(2019): Xaa can be any naturally occurring amino acid
  VARIANT (2024)..(2024): Xaa can be any naturally occurring amino acid
  VARIANT (2029)..(2029): Xaa can be any naturally occurring amino acid
  VARIANT (2034)..(2034): Xaa can be any naturally occurring amino acid
  VARIANT (2039)..(2039): Xaa can be any naturally occurring amino acid
  VARIANT (2044)..(2044): Xaa can be any naturally occurring amino acid
  VARIANT (2049)..(2049): Xaa can be any naturally occurring amino acid
  VARIANT (2054)..(2054): Xaa can be any naturally occurring amino acid
  VARIANT (2059)..(2059): Xaa can be any naturally occurring amino acid
  VARIANT (2064)..(2064): Xaa can be any naturally occurring amino acid
  VARIANT (2069)..(2069): Xaa can be any naturally occurring amino acid
  VARIANT (2074)..(2074): Xaa can be any naturally occurring amino acid
  VARIANT (2079)..(2079): Xaa can be any naturally occurring amino acid
  VARIANT (2084)..(2084): Xaa can be any naturally occurring amino acid
  VARIANT (2089)..(2089): Xaa can be any naturally occurring amino acid
  VARIANT (2094)..(2094): Xaa can be any naturally occurring amino acid
  VARIANT (2099)..(2099): Xaa can be any naturally occurring amino acid
  VARIANT (2104)..(2104): Xaa can be any naturally occurring amino acid
  VARIANT (2109)..(2109): Xaa can be any naturally occurring amino acid
  VARIANT (2114)..(2114): Xaa can be any naturally occurring amino acid
  VARIANT (2119)..(2119): Xaa can be any naturally occurring amino acid
  VARIANT (2124)..(2124): Xaa can be any naturally occurring amino acid
  VARIANT (2129)..(2129): Xaa can be any naturally occurring amino acid
  VARIANT (2134)..(2134): Xaa can be any naturally occurring amino acid
  VARIANT (2139)..(2139): Xaa can be any naturally occurring amino acid
  VARIANT (2144)..(2144): Xaa can be any naturally occurring amino acid
  VARIANT (2149)..(2149): Xaa can be any naturally occurring amino acid
  VARIANT (2154)..(2154): Xaa can be any naturally occurring amino acid
  VARIANT (2159)..(2159): Xaa can be any naturally occurring amino acid
  VARIANT (2164)..(2164): Xaa can be any naturally occurring amino acid
  VARIANT (2169)..(2169): Xaa can be any naturally occurring amino acid
  VARIANT (2174)..(2174): Xaa can be any naturally occurring amino acid
  VARIANT (2179)..(2179): Xaa can be any naturally occurring amino acid
  VARIANT (2184)..(2184): Xaa can be any naturally occurring amino acid
  VARIANT (2189)..(2189): Xaa can be any naturally occurring amino acid
  VARIANT (2194)..(2194): Xaa can be any naturally occurring amino acid
  VARIANT (2199)..(2199): Xaa can be any naturally occurring amino acid
  VARIANT (2204)..(2204): Xaa can be any naturally occurring amino acid
  VARIANT (2209)..(2209): Xaa can be any naturally occurring amino acid
  VARIANT (2214)..(2214): Xaa can be any naturally occurring amino acid
  VARIANT (2219)..(2219): Xaa can be any naturally occurring amino acid
  VARIANT (2224)..(2224): Xaa can be any naturally occurring amino acid
  VARIANT (2229)..(2229): Xaa can be any naturally occurring amino acid
  VARIANT (2234)..(2234): Xaa can be any naturally occurring amino acid
  VARIANT (2239)..(2239): Xaa can be any naturally occurring amino acid
  VARIANT (2244)..(2244): Xaa can be any naturally occurring amino acid
  VARIANT (2249)..(2249): Xaa can be any naturally occurring amino acid
  VARIANT (2254)..(2254): Xaa can be any naturally occurring amino acid
  VARIANT (2259)..(2259): Xaa can be any naturally occurring amino acid
  VARIANT (2264)..(2264): Xaa can be any naturally occurring amino acid
  VARIANT (2269)..(2269): Xaa can be any naturally occurring amino acid
  VARIANT (2274)..(2274): Xaa can be any naturally occurring amino acid
  VARIANT (2279)..(2279): Xaa can be any naturally occurring amino acid
  VARIANT (2284)..(2284): Xaa can be any naturally occurring amino acid
  VARIANT (2289)..(2289): Xaa can be any naturally occurring amino acid
  VARIANT (2294)..(2294): Xaa can be any naturally occurring amino acid
  VARIANT (2299)..(2299): Xaa can be any naturally occurring amino acid
  VARIANT (2304)..(2304): Xaa can be any naturally occurring amino acid
  VARIANT (2309)..(2309): Xaa can be any naturally occurring amino acid
  VARIANT (2314)..(2314): Xaa can be any naturally occurring amino acid
  VARIANT (2319)..(2319): Xaa can be any naturally occurring amino acid
  VARIANT (2324)..(2324): Xaa can be any naturally occurring amino acid
  VARIANT (2329)..(2329): Xaa can be any naturally occurring amino acid
  VARIANT (2334)..(2334): Xaa can be any naturally occurring amino acid
  VARIANT (2339)..(2339): Xaa can be any naturally occurring amino acid
  VARIANT (2344)..(2344): Xaa can be any naturally occurring amino acid
  VARIANT (2349)..(2349): Xaa can be any naturally occurring amino acid
  VARIANT (2354)..(2354): Xaa can be any naturally occurring amino acid
  VARIANT (2359)..(2359): Xaa can be any naturally occurring amino acid
  VARIANT (2364)..(2364): Xaa can be any naturally occurring amino acid
  VARIANT (2369)..(2369): Xaa can be any naturally occurring amino acid
  VARIANT (2374)..(2374): Xaa can be any naturally occurring amino acid
  VARIANT (2379)..(2379): Xaa can be any naturally occurring amino acid
  VARIANT (2384)..(2384): Xaa can be any naturally occurring amino acid
  VARIANT (2389)..(2389): Xaa can be any naturally occurring amino acid
  VARIANT (2394)..(2394): Xaa can be any naturally occurring amino acid
  VARIANT (2399)..(2399): Xaa can be any naturally occurring amino acid
  VARIANT (2404)..(2404): Xaa can be any naturally occurring amino acid
  VARIANT (2409)..(2409): Xaa can be any naturally occurring amino acid
  VARIANT (2414)..(2414): Xaa can be any naturally occurring amino acid
  VARIANT (2419)..(2419): Xaa can be any naturally occurring amino acid
  VARIANT (2424)..(2424): Xaa can be any naturally occurring amino acid
  VARIANT (2429)..(2429): Xaa can be any naturally occurring amino acid
  VARIANT (2434)..(2434): Xaa can be any naturally occurring amino acid
  VARIANT (2439)..(2439): Xaa can be any naturally occurring amino acid
  VARIANT (2444)..(2444): Xaa can be any naturally occurring amino acid
  VARIANT (2449)..(2449): Xaa can be any naturally occurring amino acid
  VARIANT (2454)..(2454): Xaa can be any naturally occurring amino acid
  VARIANT (2459)..(2459): Xaa can be any naturally occurring amino acid
  VARIANT (2464)..(2464): Xaa can be any naturally occurring amino acid
  VARIANT (2469)..(2469): Xaa can be any naturally occurring amino acid
  VARIANT (2474)..(2474): Xaa can be any naturally occurring amino acid
  VARIANT (2479)..(2479): Xaa can be any naturally occurring amino acid
  VARIANT (2484)..(2484): Xaa can be any naturally occurring amino acid
  VARIANT (2489)..(2489): Xaa can be any naturally occurring amino acid
  VARIANT (2494)..(2494): Xaa can be any naturally occurring amino acid
  VARIANT (2499)..(2499): Xaa can be any naturally occurring amino acid
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

SEQ ID NO: 11 - protein, 2500 aa, Artificial Sequence
  elastin-like polypeptide
  VARIANT (6)..(2500): May be present or absent in groups of the repeat unit Gly Val Gly Val Pro
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 12 - protein, 625 aa, Artificial Sequence
  elastin-like polypeptide
  VARIANT (101)..(625): May be present or absent in groups of the repeat unit Gly Val Gly Val Pro Gly Leu Gly Val Pro Gly Val Gly Val Pro Gly Leu Gly Val Pro Gly Val Gly Val Pro
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 13 - protein, 625 aa, Artificial Sequence
  elastin-like polypeptide
  VARIANT (101)..(625): May be present or absent in groups of the repeat unit Gly Val Gly Val Pro Gly Val Gly Val Pro Gly Ala Gly Val Pro Gly Val Gly Val Pro Gly Val Gly Val Pro
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 14 - protein, 625 aa, Artificial Sequence
  elastin-like polypeptide
  VARIANT (101)..(625): May be present or absent in groups of the repeat unit Gly Val Gly Val Pro Gly Trp Gly Val Pro Gly Val Gly Val Pro Gly Trp Gly Val Pro Gly Val Gly Val Pro
GVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVP

SEQ ID NO: 15 - protein, 1125 aa, Artificial Sequence
  elastin-like polypeptide
  VARIANT (181)..(1125): May be present or absent in groups of the repeat unit Gly Val Gly Val Pro Gly Val Gly Val Pro Gly Val Gly Val Pro Gly Val Gly Val Pro Gly Val Gly Val Pro Gly Val Gly Val Pro Gly Glu Gly Val Pro Gly Phe Gly Val Pro Gly Val Gly Val Pro
GVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVP

SEQ ID NO: 16 - protein, 1125 aa, Artificial Sequence
  elastin-like polypeptide
  VARIANT (181)..(1125): May be present or absent in groups of the repeat unit Gly Val Gly Val Pro Gly Val Gly Val Pro Gly Val Gly Val Pro Gly Val Gly Val Pro Gly Val Gly Val Pro Gly Val Gly Val Pro Gly Lys Gly Val Pro Gly Phe Gly Val Pro Gly Val Gly Val Pro
GVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVP

SEQ ID NO: 17 - protein, 625 aa, Artificial Sequence
  elastin-like polypeptide
  VARIANT (26)..(625): May be present or absent in groups of the repeat unit Gly Ala Gly Val Pro Gly Val Gly Val Pro Gly Ala Gly Val Pro Gly Val Gly Val Pro Gly Ala Gly Val Pro
GAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVP

SEQ ID NO: 18 - protein, 100 aa, Artificial Sequence
  Linker peptide
  VARIANT (6)..(100): May be present or absent in groups of the repeat unit Glu Ala Ala Ala Lys
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 19 - protein, 150 aa, Artificial Sequence
  Linker peptide
  VARIANT (6)..(150): May be present or absent in groups of the repeat unit Gly Gly Gly Gly Ser
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 20 - protein, 200 aa, Artificial Sequence
  Linker peptide
  VARIANT (5)..(100): May be present or absent in groups of the repeat unit Ser Gly Gly Gly
SGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGG

SEQ ID NO: 21 - protein, 80 aa, Artificial Sequence
  Linker peptide
  VARIANT (5)..(80): May be present or absent in groups of the repeat unit Gly Gly Gly Ser
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 22 - protein, 18 aa, Artificial Sequence
  Linker peptide
KESGSVSSEQLAQFRSLD

SEQ ID NO: 23 - protein, 14 aa, Artificial Sequence
  Linker peptide
EGKSSGSGSESKST

SEQ ID NO: 24 - protein, 7 aa, Artificial Sequence
  AAV linker
PRKNRPP

SEQ ID NO: 25 - protein, 5 aa, Artificial Sequence
  AAV linker
VDYPP

SEQ ID NO: 26 - protein, 5 aa, Artificial Sequence
  AAV linker
NNKPP

SEQ ID NO: 27 - protein, 5 aa, Artificial Sequence
  AAV linker
INKPP

SEQ ID NO: 28 - protein, 90 aa, Artificial Sequence
  Human PKD1
SAGESVQITLPKNEVQLNAYVLQEPPKGETYTYDWQLITHPRDYSGEMEGKHSQILKLSKLTPGLYEFKVIVEGQNAHGEGYVNVTVKPE

SEQ ID NO: 29 - protein, 90 aa, Artificial Sequence
  Human PKD2
IAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 30 - protein, 91 aa, Artificial Sequence
  Human PKD3
VANAGPNQVITLPQNSITLFGNQSTDDHGITSYEWSLSPSSKGKVVEMQGVRTPTLQLSAMQEGDYTYQLTVTDTIGQQATAQVTVIVQPE

SEQ ID NO: 31 - protein, 89 aa, Artificial Sequence
  Human PKD4
QADAGPDKELTLPVDSTTLDGSKSSDDQKIISYLWEKTQGPDGVQLENANSSVATVTGLQVGTYVFTLTVKDERNLQSQSSVNVIVKEE

SEQ ID NO: 32 - protein, 92 aa, Artificial Sequence
  Human PKD5
IAKITGNVVITLPTSTAELDGSKSSDDKGIVSYLWTRDEGSPAAGEVLNHSDHHPILFLSNLVEGTYTFHLKVTDAKGESDTDRTTVEVKPD

SEQ ID NO: 33 - protein, 477 aa, Homo sapiens
VSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPR

SEQ ID NO: 34 - protein, 478 aa, Homo sapiens
MVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPR

SEQ ID NO: 35 - protein, 1049 aa, Homo sapiens
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 36 - protein, 1048 aa, Mus musculus
MEKRLGVKPSPASWVLPGYCWQTSVKLPRSLYLLYSFFCFSVLWLSTDADESRCQQGKTLYGAGLRTEGENHLRLLAGSLPFHACRAACCRDSACHALWWLEGMCFQADCSKPQSCQPFRTDSSNSMLIIFQKSQTTDDLGLLPEDDEPHLLRLGWGRTSWRRQSLLGAPLTLSVPSSHHQSLLRDRQKRDLSVVPTHGAMQHSKVNHSEEAGALSPTSAEVRKTITVAGSFTSNHTTQTPEWPKNVSIHPEPSEHSSPVSGTPQVKSTEHSPTDAPLPVAPSYSYATPTPQASSQSTSAPHPVVKELVVSAGKSVQITLPKNEVQLNAFVLPEAEPGETYTYDWQLITHPTDYSGEVERKHSQSLQLSKLTPGLYEFKVTVDGQNAHGEGYVNVTVKPEPRKNRPPVAVVSPQFQEISLPTTSTIIDGSQSTDDDKIVQYHWEELKGPLREEKISEDTAILKLSKLVPGNYTFSLTVVDSDGATNSTTASLTVNKAVDYPPVANAGPNQVITLPQNSITLFGNQSTDDHGITSYEWSLSPSSKGKVVEMQGVRTPALQLSAMQEGDYTYQLTVTDTAGQQATAQVTVIVQPENNKPPQADAGPDKELTLPVDSTTLDGSKSTDDQRVVSYLWEQSRGPDGVQLENANSSVATVTGLQVGTYVFTLTVKDERNLQSQSSVNVIVKEEINKPPVAKIAGNVVVTLPTSTAELDGSRSSDDKGIVSYLWTRDETSPAAGEVLNHSDHHPVLFLSNLVEGTYTFHLKVTDAKGESDTDRTTVEVKPDPRKSNLVEIILDVNVSQLTERLKGMLIRQIGVLLGVLDSDIIVQKIQPYTEQSTKMLFFVQNDPPHQLFKGHEVAAMLKSELQKQKADFLIFRALEISTVTCQLNCSDHGHCDSFTKRCVCDPFWMENFIKVQLRDGDSNCEWSVLYVIIASFVIVVALGILSWTTICCCKRQKGKPKRKSRYKILDATDQESLELKPTSRAGSKQKGPTLSSSLMHSESELDSDDAIFTWPDREKGKLLYGQNGSVPNGQTPLKSRSAREEIL

SEQ ID NO: 37 - protein, 92 aa, Artificial Sequence
  Mouse PKD1
VVSAGKSVQITLPKNEVQLNAFVLPEAEPGETYTYDWQLITHPTDYSGEVERKHSQSLQLSKLTPGLYEFKVTVDGQNAHGEGYVNVTVKPE

SEQ ID NO: 38 - protein, 90 aa, Artificial Sequence
  Mouse PKD2
VAVVSPQFQEISLPTTSTIIDGSQSTDDDKIVQYHWEELKGPLREEKISEDTAILKLSKLVPGNYTFSLTVVDSDGATNSTTASLTVNKA

SEQ ID NO: 39 - protein, 91 aa, Artificial Sequence
  Mouse PKD3
VANAGPNQVITLPQNSITLFGNQSTDDHGITSYEWSLSPSSKGKVVEMQGVRTPALQLSAMQEGDYTYQLTVTDTAGQQATAQVTVIVQPE

SEQ ID NO: 40 - protein, 89 aa, Artificial Sequence
  Mouse PKD4
QADAGPDKELTLPVDSTTLDGSKSTDDQRVVSYLWEQSRGPDGVQLENANSSVATVTGLQVGTYVFTLTVKDERNLQSQSSVNVIVKEE

SEQ ID NO: 41 - protein, 92 aa, Artificial Sequence
  Mouse PKD5
VAKIAGNVVVTLPTSTAELDGSRSSDDKGIVSYLWTRDETSPAAGEVLNHSDHHPVLFLSNLVEGTYTFHLKVTDAKGESDTDRTTVEVKPD

SEQ ID NO: 42 - protein, 1049 aa, Unknown
  Pongo sp.
MEKRLGVKPNPASWILSGYYWQTSAKWLRTLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLMFLKKFQTADDLGFLPEDDVPHLLGLGWNWASWRQSPPRAALRPAVSSSDQQSLIRKLQKRGSPSEVVTPIVTQHSKVNDSNELGGLTTSGSAEVHKAITISSPLTTDLTAELPGGPKNVSAQPEIPEGLATTPSTQQVKSSEKTQIAVPQPVAPSYSYGTPTPQASFQSTSAPYPVIKELVVSAGDSVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSIATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEINTVTCQLNCSDHGHCDSFTKRCICDPFWMENFIKVQLRDGESNCEWSVLYVIIATFVIVVALGILSWTVICCCKRQKGKPKRKSKYKILDATDQESLELKPTSRTGIKQKGLVLSSSLMHSESELDSDDAIFTWPDREKGKLLHGQNGSVPNGQTPLKARSPREEIL

SEQ ID NO: 43 - protein, 92 aa, Artificial Sequence
  Orangutan PKD1
VVSAGDSVQITLPKNEVQLNAYVLQEPPKGETYTYDWQLITHPRDYSGEMEGKHSQILKLSKLTPGLYEFKVIVEGQNAHGEGYVNVTVKPE

SEQ ID NO: 44 - protein, 90 aa, Artificial Sequence; identical to SEQ ID NO: 29
  Orangutan PKD2

SEQ ID NO: 45 - protein, 91 aa, Artificial Sequence; identical to SEQ ID NO: 30
  Orangutan PKD3

SEQ ID NO: 46 - protein, 89 aa, Artificial Sequence
  Orangutan PKD4
QADAGPDKELTLPVDSTTLDGSKSSDDQKIISYLWEKTQGPDGVQLENANSSIATVTGLQVGTYVFTLTVKDERNLQSQSSVNVIVKEE

SEQ ID NO: 47 - protein, 92 aa, Artificial Sequence; identical to SEQ ID NO: 32
  Orangutan PKD5

SEQ ID NO: 48 - protein, 30 aa, Artificial Sequence
  Linker peptide
  VARIANT (2)..(30): Each individual Gly may be present or absent
GGGGGGGGGGGGGGGGGGGGGGGGGGGGGG

SEQ ID NO: 49 - protein, 79 aa, Artificial Sequence
  Human MANEC (motif at N terminus with eight cysteines)
ASESRCQQGKTQFGVGLRSGGENHLWLLEGTPSLQSCWAACCQDSACHVFWWLEGMCIQADCSRPQSCRAFRTHSSNSM

SEQ ID NO: 50 - protein, 79 aa, Artificial Sequence
  Mouse MANEC (motif at N terminus with eight cysteines)
ADESRCQQGKTLYGAGLRTEGENHLRLLAGSLPFHACRAACCRDSACHALWWLEGMCFQADCSKPQSCQPFRTDSSNSM

SEQ ID NO: 51 - protein, 79 aa, Artificial Sequence; identical to SEQ ID NO: 49
  Orangutan MANEC (motif at N terminus with eight cysteines)

SEQ ID NO: 52 - protein, 100 aa, Artificial Sequence
  Recombinant PKD2
GNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 53 - protein, 100 aa, Artificial Sequence
  Recombinant PKD2
GNRPPIAIVSPQFQEISLPTTSTVIDGHQSTDDDKIVQYHWEELKGPLREEKISEDTAILKLSKLVPGNYTFSLTVVDSDGATNSTTANLTVNKAVDYPG

SEQ ID NO: 54 - protein, 100 aa, Artificial Sequence
  Recombinant PKD2
GNRPPIAIVSPQFQEISLPTTSTVIDGSHSTDDDKIVQYHWEELKGPLREEKISEDTAILKLSKLVPGNYTFSLTVVDSDGATNSTTANLTVNKAVDYPG

SEQ ID NO: 55 - protein, 100 aa, Artificial Sequence
  Recombinant PKD2
GNRPPIAIVSPQFQEISLPTTSTVIDGSQSHDDDKIVQYHWEELKGPLREEKISEDTAILKLSKLVPGNYTFSLTVVDSDGATNSTTANLTVNKAVDYPG

SEQ ID NO: 56 - protein, 100 aa, Artificial Sequence
  Recombinant PKD2
GNRPPIAIVSPQFQEISLPTTSTVIDGSQSTDDHKIVQYHWEELKGPLREEKISEDTAILKLSKLVPGNYTFSLTVVDSDGATNSTTANLTVNKAVDYPG

SEQ ID NO: 57 - protein, 100 aa, Artificial Sequence
  Recombinant PKD2
GNRPPIAIVSPQFQEISLPTTSTVIDGSQSTDDDHIVQYHWEELKGPLREEKISEDTAILKLSKLVPGNYTFSLTVVDSDGATNSTTANLTVNKAVDYPG

SEQ ID NO: 58 - protein, 100 aa, Artificial Sequence
  Recombinant PKD2
GNRPPIAIVSPQFQEISLPTTSTVIDGSQSTDDDKHVQYHWEELKGPLREEKISEDTAILKLSKLVPGNYTFSLTVVDSDGATNSTTANLTVNKAVDYPG

SEQ ID NO: 59 - protein, 100 aa, Artificial Sequence
  Recombinant PKD2
GNRPPIAIVSPQFQEISLPTTSTVIDGSQSTDDDKIHQYHWEELKGPLREEKISEDTAILKLSKLVPGNYTFSLTVVDSDGATNSTTANLTVNKAVDYPG

SEQ ID NO: 60 - protein, 100 aa, Artificial Sequence
  Recombinant PKD2
GNRPPIAIVSPQFQEISLPTTSTVIDGSQSTDDDKIVQHHWEELKGPLREEKISEDTAILKLSKLVPGNYTFSLTVVDSDGATNSTTANLTVNKAVDYPG

SEQ ID NO: 61 - protein, 100 aa, Artificial Sequence
  Recombinant PKD2
GNRPPIAIVSPQFQEISLPTTSTVIDGSQSTDDDKIVQYHWEELKGPLREEKISEDTAHLKLSKLVPGNYTFSLTVVDSDGATNSTTANLTVNKAVDYPG

SEQ ID NO: 62 - protein, 100 aa, Artificial Sequence
  Recombinant PKD2
GNRPPIAIVSPQFQEISLPTTSTVIDGSQSTDDDKIHQHHWEELKGPLREEKISEDTAILKLSKLVPGNYTFSLTVVDSDGATNSTTANLTVNKAVDYPG

SEQ ID NO: 63 - protein, 100 aa, Artificial Sequence
  Recombinant PKD2
GNRPPIAIVSPQFQEISLPTTSTVIDGHHSTDDDKIVQYHWEELKGPLREEKISEDTAILKLSKLVPGNYTFSLTVVDSDGATNSTTANLTVNKAVDYPG

SEQ ID NO: 64 - protein, 99 aa, Artificial Sequence
  Recombinant PKD2
GNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYP

SEQ ID NO: 65 - protein, 99 aa, Artificial Sequence
  Recombinant PKD2
GNRPPIAIVSPQFQEISLPTTSTVIDGHQSTDDDKIVQYHWEELKGPLREEKISEDTAILKLSKLVPGNYTFSLTVVDSDGATNSTTANLTVNKAVDYP

SEQ ID NO: 66 - protein, 99 aa, Artificial Sequence
  Recombinant PKD2
GNRPPIAIVSPQFQEISLPTTSTVIDGSHSTDDDKIVQYHWEELKGPLREEKISEDTAILKLSKLVPGNYTFSLTVVDSDGATNSTTANLTVNKAVDYP

SEQ ID NO: 67 - protein, 99 aa, Artificial Sequence
  Recombinant PKD2
GNRPPIAIVSPQFQEISLPTTSTVIDGSQSHDDDKIVQYHWEELKGPLREEKISEDTAILKLSKLVPGNYTFSLTVVDSDGATNSTTANLTVNKAVDYP

SEQ ID NO: 68 - protein, 99 aa, Artificial Sequence
  Recombinant PKD2
GNRPPIAIVSPQFQEISLPTTSTVIDGSQSTDDHKIVQYHWEELKGPLREEKISEDTAILKLSKLVPGNYTFSLTVVDSDGATNSTTANLTVNKAVDYP

SEQ ID NO: 69 - protein, 99 aa, Artificial Sequence
  Recombinant PKD2
GNRPPIAIVSPQFQEISLPTTSTVIDGSQSTDDDHIVQYHWEELKGPLREEKISEDTAILKLSKLVPGNYTFSLTVVDSDGATNSTTANLTVNKAVDYP

SEQ ID NO: 70 - protein, 99 aa, Artificial Sequence
  Recombinant PKD2
GNRPPIAIVSPQFQEISLPTTSTVIDGSQSTDDDKHVQYHWEELKGPLREEKISEDTAILKLSKLVPGNYTFSLTVVDSDGATNSTTANLTVNKAVDYP

SEQ ID NO: 71 - protein, 99 aa, Artificial Sequence
  Recombinant PKD2
GNRPPIAIVSPQFQEISLPTTSTVIDGSQSTDDDKIHQYHWEELKGPLREEKISEDTAILKLSKLVPGNYTFSLTVVDSDGATNSTTANLTVNKAVDYP

SEQ ID NO: 72 - protein, 99 aa, Artificial Sequence
  Recombinant PKD2
GNRPPIAIVSPQFQEISLPTTSTVIDGSQSTDDDKIVQHHWEELKGPLREEKISEDTAILKLSKLVPGNYTFSLTVVDSDGATNSTTANLTVNKAVDYP

SEQ ID NO: 73 - protein, 99 aa, Artificial Sequence
  Recombinant PKD2
GNRPPIAIVSPQFQEISLPTTSTVIDGSQSTDDDKIVQYHWEELKGPLREEKISEDTAHLKLSKLVPGNYTFSLTVVDSDGATNSTTANLTVNKAVDYP

SEQ ID NO: 74 - protein, 99 aa, Artificial Sequence
  Recombinant PKD2
GNRPPIAIVSPQFQEISLPTTSTVIDGSQSTDDDKIHQHHWEELKGPLREEKISEDTAILKLSKLVPGNYTFSLTVVDSDGATNSTTANLTVNKAVDYP

SEQ ID NO: 75 - protein, 99 aa, Artificial Sequence
  Recombinant PKD2
GNRPPIAIVSPQFQEISLPTTSTVIDGHHSTDDDKIVQYHWEELKGPLREEKISEDTAILKLSKLVPGNYTFSLTVVDSDGATNSTTANLTVNKAVDYP

SEQ ID NO: 76 - protein, 90 aa, Artificial Sequence
  Recombinant PKD2
IAIVSPQFQEISLPTTSTVIDGHQSTDDDKIVQYHWEELKGPLREEKISEDTAILKLSKLVPGNYTFSLTVVDSDGATNSTTANLTVNKA

SEQ ID NO: 77 - protein, 90 aa, Artificial Sequence
  Recombinant PKD2
IAIVSPQFQEISLPTTSTVIDGSHSTDDDKIVQYHWEELKGPLREEKISEDTAILKLSKLVPGNYTFSLTVVDSDGATNSTTANLTVNKA

SEQ ID NO: 78 - protein, 90 aa, Artificial Sequence
  Recombinant PKD2
IAIVSPQFQEISLPTTSTVIDGSQSHDDDKIVQYHWEELKGPLREEKISEDTAILKLSKLVPGNYTFSLTVVDSDGATNSTTANLTVNKA

SEQ ID NO: 79 - protein, 90 aa, Artificial Sequence
  Recombinant PKD2
IAIVSPQFQEISLPTTSTVIDGSQSTDDHKIVQYHWEELKGPLREEKISEDTAILKLSKLVPGNYTFSLTVVDSDGATNSTTANLTVNKA

SEQ ID NO: 80 - protein, 90 aa, Artificial Sequence
  Recombinant PKD2
IAIVSPQFQEISLPTTSTVIDGSQSTDDDHIVQYHWEELKGPLREEKISEDTAILKLSKLVPGNYTFSLTVVDSDGATNSTTANLTVNKA

SEQ ID NO: 81 - protein, 90 aa, Artificial Sequence
  Recombinant PKD2
IAIVSPQFQEISLPTTSTVIDGSQSTDDDKHVQYHWEELKGPLREEKISEDTAILKLSKLVPGNYTFSLTVVDSDGATNSTTANLTVNKA

SEQ ID NO: 82 - protein, 90 aa, Artificial Sequence
  Recombinant PKD2
IAIVSPQFQEISLPTTSTVIDGSQSTDDDKIHQYHWEELKGPLREEKISEDTAILKLSKLVPGNYTFSLTVVDSDGATNSTTANLTVNKA

SEQ ID NO: 83 - protein, 90 aa, Artificial Sequence
  Recombinant PKD2
IAIVSPQFQEISLPTTSTVIDGSQSTDDDKIVQHHWEELKGPLREEKISEDTAILKLSKLVPGNYTFSLTVVDSDGATNSTTANLTVNKA

SEQ ID NO: 84 - protein, 90 aa, Artificial Sequence
  Recombinant PKD2
IAIVSPQFQEISLPTTSTVIDGSQSTDDDKIVQYHWEELKGPLREEKISEDTAHLKLSKLVPGNYTFSLTVVDSDGATNSTTANLTVNKA

SEQ ID NO: 85 - protein, 90 aa, Artificial Sequence
  Recombinant PKD2
IAIVSPQFQEISLPTTSTVIDGSQSTDDDKIHQHHWEELKGPLREEKISEDTAILKLSKLVPGNYTFSLTVVDSDGATNSTTANLTVNKA

SEQ ID NO: 86 - protein, 90 aa, Artificial Sequence
  Recombinant PKD2
IAIVSPQFQEISLPTTSTVIDGHHSTDDDKIVQYHWEELKGPLREEKISEDTAILKLSKLVPGNYTFSLTVVDSDGATNSTTANLTVNKA

SEQ ID NO: 87 - protein, 500 aa, Artificial Sequence
  Purification Matrix
GNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPG

SEQ ID NO: 88 - protein, 401 aa, Artificial Sequence
  Polypeptide with Phase Behavior
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPG

SEQ ID NO: 89 - protein, 5 aa, Artificial Sequence
  AAV-binding polypeptide optional N-terminal sequence
GNRPP

SEQ ID NO: 90 - protein, 5 aa, Artificial Sequence
  AAV-binding polypeptide optional C-terminal sequence
VYDPG

SEQ ID NO: 91 - protein, 4 aa, Artificial Sequence
  AAV-binding polypeptide optional C-terminal sequence
VYDP

SEQ ID NO: 92 - protein, 290 aa, Artificial Sequence
  AAV binding polypeptide
MASVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNK

SEQ ID NO: 93 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 94 - DNA, 300 bp, Artificial Sequence
  Recombinant PKD2
gggaatcgtccgcccatcgctattgtcagccctcaatttcaggagatcagcttgccgacaacctccactgtaattgatggtcatcagtcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 95 - DNA, 300 bp, Artificial Sequence
  Recombinant PKD2
gggaatcgtccgcccatcgctattgtcagccctcaatttcaggagatcagcttgccgacaacctccactgtaattgatggttcccattcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 96 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgcatgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 97 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgaccataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 98 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgatcatatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 99 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaacatgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 100 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaaatccatcaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 101 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaaatcgtacaacatcactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 102 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaaatcgtacaataccactgggaggaactcaaggggccgctgcgtgaggaaaagatcagcgaggataccgcacatttgaaacttagtaaactggttcccggcaactacacattttctttaacggttgtagactcggatggtgccaccaactctacgaccgctaatcttacagtgaacaaagcggtcgattatccgggc

SEQ ID NO: 103 - DNA, 300 bp, Artificial Sequence
  Recombinant PKD2
gggaatcgtccgcccatcgctattgtcagccctcaatttcaggagatcagcttgccgacaacctccactgtaattgatggttcccagtcgaccgacgacgataaaatccaccaacatcactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 104 - DNA, 300 bp, Artificial Sequence
  Recombinant PKD2
gggaatcgtccgcccatcgctattgtcagccctcaatttcaggagatcagcttgccgacaacctccactgtaattgatggtcatcactcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggc

SEQ ID NO: 105 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 106 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggtcatcagtcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 107 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccattcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 108 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgcatgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 109 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgaccataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 110 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgatcatatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 111 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaacatgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 112 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaaatccatcaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 113 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaaatcgtacaacatcactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 114 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaaatcgtacaataccactgggaggaactcaaggggccgctgcgtgaggaaaagatcagcgaggataccgcacatttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 115 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggttcccagtcgaccgacgacgataaaatccaccaacatcactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 116 - DNA, 400 bp, Artificial Sequence
  Recombinant PKD2
aattcccctctagaaataattttgtttaactttaagaaggaggagtacatatggggaatcgtccgcccatcgctattgtcagccctcaatttcaggagatcagcttgccgacaacctccactgtaattgatggtcatcactcgaccgacgacgataaaatcgtacaataccactgggaggaactcaaggggccgctgcgtgaggaaaagatcagcgaggataccgcaattttgaaacttagtaaactggttcccggcaactacacattttctttaacggttgtagactcggatggtgccaccaactctacgaccgctaatcttacagtgaacaaagcggtcgattatccgggctactgataatgatcttcaggatccgaattcgagctccgtcgacaagc

SEQ ID NO: 117 - protein, 58 aa, Artificial Sequence [sequence omitted]

SEQ ID NO: 118 - protein, 59 aa, Artificial Sequence
  Capture domain
VDNKFNKEQQNAFYEILSLPNLNEEQRAAFIQSLKDDPSQSANLLAEAKKLNDAQAPKG

SEQ ID NO: 119 - protein, 59 aa, Artificial Sequence
  Capture domain
VDNKFNKEHQNAFYEILHLPNLNEEQRNAFIQSLKHDPSQSANLLAEAKKLNDAQAPKG

SEQ ID NO: 120 - protein, 254 aa, Artificial Sequence
  Capture domain
AQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPN

SEQ ID NO: 121 - protein, 56 aa, Artificial Sequence
  Capture domain
TYKLILNGKTLKGETTTEAVDAATAEKVFKQYANDNGVDGEWTYDDATKTFTVTEG

SEQ ID NO: 122 - protein, 189 aa, Artificial Sequence
  Capture domain
KTDTYKLILNGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKDDAKKAET

SEQ ID NO: 123 - protein, 76 aa, Artificial Sequence
  Capture domain
KEETPETPETDSEEEVTIKANLIFANGSTQTAEFKGTFEKATSEAYAYADTLKKDNGEYTVDVADKGYTLNLKFAG

SEQ ID NO: 124 - protein, 7 aa, Artificial Sequence
  Capture domain
  VARIANT (5)..(7): Xaa can be any naturally occurring amino acid
GYVSXXX

SEQ ID NO: 125 - protein, 226 aa, Artificial Sequence
  Capture domain
SDVQLQESGPDLVKPSQSLSLTCTVTGYSITSGYTWHWIRQFPGNKQEWGYIHFSGYTNYNPSLKSRVSITRDTSKNQFFLHLNSVTTEDTATYYCARGDYGYEWFTYWGQGTLVTVSADIQMTQSSSSFSVSLGDRVTITCKASEDIHNRLAWYKQKPGNAPRLLISGATSLETGVPSRFSGSGSGKDYTLSITSLQNEDVATYYCQQYWIGPFTFGSGTNLEIK

SEQ ID NO: 126 - protein, 11 aa, Artificial Sequence
  Capture domain
GYVSRHPGGGC

SEQ ID NO: 127 - protein, 12 aa, Artificial Sequence
  Capture domain
GYVSRHPGGGGS

SEQ ID NO: 128 - protein, 11 aa, Artificial Sequence
  Capture domain
FHENWPSGGGC

SEQ ID NO: 129 - protein, 12 aa, Artificial Sequence
  Capture domain
FHENWPSGGGGS

SEQ ID NO: 130 - protein, 7 aa, Artificial Sequence
  Capture domain
GVVTINP

SEQ ID NO: 131 - protein, 7 aa, Artificial Sequence
  Capture domain
GLVTPSG

SEQ ID NO: 132 - protein, 7 aa, Artificial Sequence
  Capture domain
GYVSHRS

SEQ ID NO: 133 - protein, 7 aa, Artificial Sequence
  Capture domain
KVWILTP

SEQ ID NO: 134 - protein, 7 aa, Artificial Sequence
  Capture domain
KLWVIPQ

SEQ ID NO: 135 - protein, 479 aa, Artificial Sequence
  Capture domain
GVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRG

SEQ ID NO: 136 - protein, 90 aa, Artificial Sequence; identical to SEQ ID NO: 28
  Capture domain

SEQ ID NO: 137 - protein, 90 aa, Artificial Sequence; identical to SEQ ID NO: 29
  Capture domain

SEQ ID NO: 138 - protein, 190 aa, Artificial Sequence
  Capture domain
MGVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 139 - protein, 91 aa, Artificial Sequence; identical to SEQ ID NO: 30
  Capture domain

SEQ ID NO: 140 - protein, 89 aa, Artificial Sequence; identical to SEQ ID NO: 31
  Capture domain

SEQ ID NO: 141 - protein, 93 aa, Artificial Sequence
  Capture domain
IAKITGNVVITLPTSTAELDGSKSSDDKGIVSYLWTRDEGSPAAGEVLNHSDHHPILFLSNLVEGTYTFHLKVTDAKGESDTDRTTVEVKPDP

SEQ ID NO: 142 - protein, 46 aa, Artificial Sequence
  Capture domain
LAEAKVLANRELDKYGVSDYYKNLINNAKTVEGVKALIDEILAALP

SEQ ID NO: 143 - protein, 800 aa, Artificial Sequence
  elastin-like polypeptide
  VARIANT (61)..(800): May be present or absent in groups of the repeat unit Gly Val Gly Val Pro
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 144 - protein, 800 aa, Artificial Sequence
  elastin-like polypeptide
  VARIANT (51)..(800): May be present or absent in groups of the repeat unit Gly Val Gly Val Pro Gly Val Gly Val Pro Gly Ala Gly Val Pro Gly Val Gly Val Pro Gly Val Gly Val Pro
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 145 - protein, 800 aa, Artificial Sequence
  elastin-like polypeptide
  VARIANT (51)..(800): May be present or absent in groups of the repeat unit Gly Val Gly Val Pro Gly Ala Gly Val Pro
GVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVP

SEQ ID NO: 146 - protein, 800 aa, Artificial Sequence
  elastin-like polypeptide
  VARIANT (51)..(800): May be present or absent in groups of the repeat unit Gly Val Gly Val Pro Gly Val Gly Val Pro Gly Leu Gly Val Pro Gly Val Gly Val Pro Gly Val Gly Val Pro
GVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVP

SEQ ID NO: 147 - protein, 800 aa, Artificial Sequence
  elastin-like polypeptide
  VARIANT (2)..(2): Xaa can be Gly, Ala, Val, Ile, Leu, Phe, Tyr, Trp, Lys, Arg, Asp, Glu or Ser
  VARIANT (7)..(7): Xaa can be Gly, Ala, Val, Ile, Leu, Phe, Tyr, Trp, Lys, Arg, Asp, Glu or Ser
  VARIANT (12)..(12): Xaa can be Gly, Ala, Val, Ile, Leu, Phe, Tyr, Trp, Lys, Arg, Asp, Glu or Ser
  VARIANT (17)..(17): Xaa can be Gly, Ala, Val, Ile, Leu, Phe, Tyr, Trp, Lys, Arg, Asp, Glu or Ser
  VARIANT (22)..(22): Xaa can be Gly, Ala, Val, Ile, Leu, Phe, Tyr, Trp, Lys, Arg, Asp, Glu or Ser
  VARIANT (27)..(27): Xaa can be Gly, Ala, Val, Ile, Leu, Phe, Tyr, Trp, Lys, Arg, Asp, Glu or Ser
  VARIANT (32)..(32): Xaa can be Gly, Ala, Val, Ile, Leu, Phe, Tyr, Trp, Lys, Arg, Asp, Glu or Ser
  VARIANT (37)..(37): Xaa can be Gly, Ala, Val, Ile, Leu, Phe, Tyr, Trp, Lys, Arg, Asp, Glu or Ser
  VARIANT (42)..(42): Xaa can be Gly, Ala, Val, Ile, Leu, Phe, Tyr, Trp, Lys, Arg, Asp, Glu or Ser
  VARIANT (47)..(47): Xaa can be Gly, Ala, Val, Ile, Leu, Phe, Tyr, Trp, Lys, Arg, Asp, Glu or Ser
  VARIANT (51)..(800): May be present or absent in groups of the repeat unit Gly Xaa Gly Val Pro
  VARIANT (52)..(52): Xaa can be Gly, Ala, Val, Ile, Leu, Phe, Tyr, Trp, Lys, Arg, Asp, Glu or Ser
  VARIANT (57)..(57): Xaa can be Gly, Ala, Val, Ile, Leu, Phe, Tyr, Trp, Lys, Arg, Asp, Glu or Ser
  VARIANT (62)..(62): Xaa can be Gly, Ala, Val, Ile, Leu, Phe, Tyr, Trp, Lys, Arg, Asp, Glu or Ser
  VARIANT (67)..(67): Xaa can be Gly, Ala, Val, Ile, Leu, Phe, Tyr, Trp, Lys, Arg, Asp, Glu or Ser
  VARIANT (72)..(72): Xaa can be Gly, Ala, Val, Ile, Leu, Phe, Tyr, Trp, Lys, Arg, Asp, Glu or Ser
  VARIANT (77)..(77): Xaa can be Gly, Ala, Val, Ile, Leu, Phe, Tyr, Trp, Lys, Arg, Asp, Glu or Ser
  VARIANT (82)..(82): Xaa can be Gly, Ala, Val, Ile, Leu, Phe, Tyr, Trp, Lys, Arg, Asp, Glu or Ser
  VARIANT (87)..(87): Xaa can be Gly, Ala, Val, Ile, Leu, Phe, Tyr, Trp, Lys, Arg, Asp, Glu or Ser
  VARIANT (92)..(92): Xaa can be Gly, Ala, Val, Ile, Leu, Phe, Tyr, Trp, Lys, Arg, Asp, Glu or Ser
  VARIANT (97)..(97): Xaa can be Gly, Ala, Val, Ile, Leu, Phe, Tyr, Trp, Lys, Arg, Asp, Glu or Ser
  VARIANT (102)..(102): Xaa can be Gly, Ala, Val, Ile, Leu, Phe, Tyr, Trp, Lys, Arg, Asp, Glu or Ser
  VARIANT (107)..(107): Xaa can be Gly, Ala, Val, Ile, Leu, Phe, Tyr, Trp, Lys, Arg, Asp, Glu or Ser
  VARIANT (112)..(112): Xaa can be Gly, Ala, Val, Ile, Leu, Phe, Tyr, Trp, Lys, Arg, Asp, Glu or Ser
  VARIANT (117)..(117): Xaa can be Gly, Ala, Val, Ile, Leu, Phe, Tyr, Trp, Lys, Arg, Asp, Glu or Ser
  VARIANT (122)..(122): Xaa can be Gly, Ala, Val, Ile, Leu, Phe, Tyr, Trp, Lys, Arg, Asp, Glu or Ser
  VARIANT (127)..(127): Xaa can be Gly, Ala, Val, Ile, Leu, Phe, Tyr, Trp, Lys, Arg, Asp, Glu or Ser
  VARIANT (132)..(132): Xaa can be Gly, Ala, Val, Ile, Leu, Phe, Tyr, Trp, Lys, Arg, Asp, Glu or Ser
  VARIANT (137)..(137): Xaa can be Gly, Ala, Val, Ile, Leu, Phe, Tyr, Trp, Lys, Arg, Asp, Glu or Ser
  VARIANT (142)..(142): Xaa can be Gly, Ala, Val, Ile, Leu, Phe, Tyr, Trp, Lys, Arg, Asp, Glu or Ser
  VARIANT (147)..(147): Xaa can be Gly, Ala, Val, Ile, Leu, Phe, Tyr, Trp, Lys, Arg, Asp, Glu or Ser
  VARIANT (152)..(152): Xaa can be Gly, Ala, Val, Ile, Leu, Phe, Tyr, Trp, Lys, Arg, Asp, Glu or Ser
  VARIANT (157)..(157): Xaa can be Gly, Ala, Val, Ile, Leu, Phe, Tyr, Trp, Lys, Arg, Asp, Glu or Ser
  VARIANT (162)..(162): Xaa can be Gly, Ala, Val, Ile, Leu, Phe, Tyr, Trp, Lys, Arg, Asp, Glu or Ser
  VARIANT (167)..(167): Xaa can be Gly, Ala, Val, Ile, Leu, Phe, Tyr, Trp, Lys, Arg, Asp, Glu or Ser
  VARIANT (172)..(172): Xaa can be Gly, Ala, Val, Ile, Leu, Phe, Tyr, Trp, Lys, Arg, Asp, Glu or Ser
  VARIANT (177)..(177): Xaa can be Gly, Ala, Val, Ile, Leu, Phe, Tyr, Trp, Lys, Arg, Asp, Glu or Ser
  VARIANT (182)..(182): Xaa can be Gly, Ala, Val, Ile, Leu, Phe, Tyr, Trp, Lys, Arg, Asp, Glu or Ser
  VARIANT (187)..(187): Xaa can be Gly, Ala, Val, Ile, Leu, Phe, Tyr, Trp, Lys, Arg, Asp, Glu or Ser
  VARIANT (192)..(192): Xaa can be Gly, Ala, Val, Ile, Leu, Phe, Tyr, Trp, Lys, Arg, Asp, Glu or Ser
  VARIANT (197)..(197): Xaa can be Gly, Ala, Val, Ile, Leu, Phe, Tyr, Trp, Lys, Arg, Asp, Glu or Ser
  VARIANT (202)..(202): Xaa can be Gly, Ala, Val, Ile, Leu, Phe, Tyr, Trp, Lys, Arg, Asp, Glu or Ser
  VARIANT (207)..(207): Xaa can be Gly, Ala, Val, Ile, Leu, Phe, Tyr, Trp, Lys, Arg, Asp, Glu or Ser
  VARIANT (212)..(212): Xaa can be Gly, Ala, Val, Ile, Leu, Phe, Tyr, Trp, Lys, Arg, Asp, Glu or Ser
  VARIANT (217)..(217): Xaa can be Gly, Ala, Val, Ile, Leu, Phe, Tyr, Trp, Lys, Arg, Asp, Glu or Ser
  VARIANT (222)..(222): Xaa can be Gly, Ala, Val, Ile, Leu, Phe, Tyr, Trp, Lys, Arg, Asp, Glu or Ser
  VARIANT (227)..(227): Xaa can be Gly, Ala, Val, Ile, Leu, Phe, Tyr, Trp, Lys, Arg, Asp, Glu or Ser
  VARIANT (232)..(232): Xaa can be Gly, Ala, Val, Ile, Leu, Phe, Tyr, Trp, Lys, Arg, Asp, Glu or Ser
  VARIANT (237)..(237): Xaa can be Gly, Ala, Val, Ile, Leu, Phe, Tyr, Trp, Lys, Arg, Asp, Glu or Ser
  VARIANT (242)..(242): Xaa can be Gly, Ala, Val, Ile, Leu, Phe, Tyr, Trp, Lys, Arg, Asp, Glu or Ser
  VARIANT (247)..(247): Xaa can be Gly, Ala, Val, Ile, Leu, Phe, Tyr, Trp, Lys, Arg, Asp, Glu or Ser
  VARIANT (252)..(252): Xaa can be Gly, Ala, Val, Ile, Leu, Phe, Tyr, Trp, Lys, Arg, Asp, Glu or Ser
  VARIANT (257)..(257): Xaa can be Gly, Ala, Val, Ile, Leu, Phe, Tyr, Trp, Lys, Arg, Asp, Glu or Ser
  VARIANT (262)..(262): Xaa can be Gly, Ala, Val, Ile, Leu, Phe, Tyr, Trp, Lys, Arg, Asp, Glu or Ser
  VARIANT (267)..(267): Xaa can be Gly, Ala, Val, Ile, Leu, Phe, Tyr, Trp, Lys, Arg, Asp, Glu or Ser
  VARIANT (272)..(272): Xaa can be Gly, Ala, Val, Ile, Leu, Phe, Tyr, Trp, Lys, Arg, Asp, Glu or Ser
  VARIANT (277)..(277): Xaa can be Gly, Ala, Val, Ile, Leu, Phe, Tyr, Trp, Lys, Arg, Asp, Glu or Ser
  VARIANT (282)..(282): Xaa can be Gly, Ala, Val, Ile, Leu, Phe, Tyr, Trp, Lys, Arg, Asp, Glu or Ser
  VARIANT (287)..(287): Xaa can be Gly, Ala, Val, Ile, Leu, Phe, Tyr, Trp, Lys, Arg, Asp, Glu or Ser
  VARIANT (292)..(292): Xaa can be Gly, Ala, Val, Ile, Leu, Phe, Tyr, Trp, Lys, Arg, Asp, Glu or Ser
  VARIANT (297)..(297): Xaa can be Gly, Ala, Val, Ile, Leu, Phe, Tyr, Trp, Lys, Arg, Asp, Glu or Ser
  VARIANT (302)..(302): Xaa can be Gly, Ala, Val, Ile, Leu, Phe, Tyr, Trp, Lys, Arg, Asp, Glu or Ser
  VARIANT (307)..(307): Xaa can be Gly, Ala, Val, Ile, Leu, Phe, Tyr, Trp, Lys, Arg, Asp, Glu or Ser
  VARIANT (312)..(312): Xaa can be Gly, Ala, Val, Ile, Leu, Phe, Tyr, Trp, Lys, Arg, Asp, Glu or Ser
  VARIANT (317)..(317): Xaa can be Gly, Ala, Val, Ile, Leu, Phe, Tyr, Trp, Lys, Arg, Asp, Glu or Ser
  VARIANT (322)..(322): Xaa can be Gly, Ala, Val, Ile, Leu, Phe, Tyr, Trp, Lys, Arg, Asp, Glu or Ser
  VARIANT (327)..(327): Xaa can be Gly, Ala, Val, Ile, Leu, Phe, Tyr, Trp, Lys, Arg, Asp, Glu or Ser
  VARIANT (332)..(332): Xaa can be Gly, Ala, Val, Ile, Leu, Phe, Tyr, Trp, Lys, Arg, Asp, Glu or Ser
  VARIANT (337)..(337): Xaa can be Gly, Ala, Val, Ile, Leu, Phe, Tyr, Trp, Lys, Arg, Asp, Glu or Ser
  VARIANT (342)..(342): Xaa can be Gly, Ala, Val, Ile, Leu, Phe, Tyr, Trp, Lys, Arg, Asp, Glu or Ser
  VARIANT (347)..(347): Xaa can be Gly, Ala, Val, Ile, Leu, Phe, Tyr, Trp, Lys, Arg, Asp, Glu or Ser
  VARIANT (352)..(352): Xaa can be Gly, Ala, Val, Ile, Leu, Phe, Tyr, Trp, Lys, Arg, Asp, Glu or Ser
  VARIANT (357)..(357): Xaa can be Gly, Ala, Val, Ile, Leu, Phe, Tyr, Trp, Lys, Arg, Asp, Glu or Ser
  VARIANT (362)..(362): Xaa can be Gly, Ala, Val, Ile, Leu, Phe, Tyr, Trp, Lys, Arg, Asp, Glu or Ser
  VARIANT (367)..(367): Xaa can be Gly, Ala, Val, Ile, Leu, Phe, Tyr, Trp, Lys, Arg, Asp, Glu or Ser
  VARIANT (372)..(372): Xaa can be Gly, Ala, Val, Ile, Leu, Phe, Tyr, Trp, Lys, Arg, Asp, Glu or Ser
  VARIANT (377)..(377): Xaa can be Gly, Ala, Val, Ile, Leu, Phe, Tyr, Trp, Lys, Arg, Asp, Glu or Ser
  VARIANT (382)..(382): Xaa can be Gly, Ala, Val, Ile, Leu, Phe, Tyr, Trp, Lys, Arg, Asp, Glu or Ser
  VARIANT (387)..(387): Xaa can be Gly, Ala, Val, Ile, Leu, Phe, Tyr, Trp, Lys, Arg, Asp, Glu or Ser
  VARIANT (392)..(392): Xaa can be Gly, Ala, Val, Ile, Leu, Phe, Tyr, Trp, Lys, Arg, Asp, Glu or Ser
  VARIANT (397)..(397): Xaa can be Gly, Ala, Val, Ile, Leu, Phe, Tyr, Trp, Lys, Arg, Asp, Glu or Ser
  VARIANT (402)..(402): Xaa can be Gly, Ala, Val, Ile, Leu, Phe, Tyr, Trp, Lys, Arg, Asp, Glu or Ser
  VARIANT (407)..(407): Xaa can be Gly, Ala, Val, Ile, Leu, Phe, Tyr, Trp, Lys, Arg, Asp, Glu or Ser
  VARIANT (412)..(412): Xaa can be Gly, Ala, Val, Ile, Leu, Phe, Tyr, Trp, Lys, Arg, Asp, Glu or Ser
  VARIANT (417)..(417): Xaa can be Gly, Ala, Val, Ile, Leu, Phe, Tyr, Trp, Lys, Arg, Asp, Glu or Ser
  VARIANT (422)..(422): Xaa can be Gly, Ala, Val, Ile, Leu, Phe, Tyr, Trp, Lys, Arg, Asp, Glu or Ser
  VARIANT (427)..(427): Xaa can be Gly, Ala, Val, Ile, Leu, Phe, Tyr, Trp, Lys, Arg, Asp, Glu or Ser
  VARIANT (432)..(432): Xaa can be Gly, Ala, Val, Ile, Leu, Phe, Tyr, Trp, Lys, Arg, Asp, Glu or Ser
  VARIANT (437)..(437): Xaa can be Gly, Ala, Val, Ile, Leu, Phe, Tyr, Trp, Lys, Arg, Asp, Glu or Ser
  VARIANT (442)..(442): Xaa can be Gly, Ala, Val, Ile, Leu, Phe, Tyr, Trp, Lys, Arg, Asp, Glu or Ser
  VARIANT (447)..(447): Xaa can be Gly, Ala, Val, Ile, Leu, Phe, Tyr, Trp, Lys, Arg, Asp, Glu or Ser
  VARIANT (452)..(452): Xaa can be Gly, Ala, Val, Ile, Leu, Phe, Tyr, Trp, Lys, Arg, Asp, Glu or Ser
  VARIANT (457)..(457): Xaa can be Gly, Ala, Val, Ile, Leu, Phe, Tyr, Trp, Lys, Arg, Asp, Glu or Ser
  VARIANT (462)..(462): Xaa can be Gly, Ala, Val, Ile, Leu, Phe, Tyr, Trp, Lys, Arg, Asp, Glu or Ser
  VARIANT (467)..(467): Xaa can be Gly, Ala, Val, Ile, Leu, Phe, Tyr, Trp, Lys, Arg, Asp, Glu or Ser
  VARIANT (472)..(472): Xaa can be Gly, Ala, Val, Ile, Leu, Phe, Tyr, Trp, Lys, Arg, Asp, Glu or Ser
  VARIANT (477)..(477): Xaa can be Gly, Ala, Val, Ile, Leu, Phe, Tyr, Trp, Lys, Arg, Asp, Glu or Ser
  VARIANT (482)..(482): Xaa can be Gly, Ala, Val, Ile, Leu, Phe, Tyr, Trp, Lys, Arg, Asp, Glu or Ser
  VARIANT (487)..(487): Xaa can be Gly, Ala, Val, Ile, Leu, Phe, Tyr, Trp, Lys, Arg, Asp, Glu or Ser
  VARIANT (492)..(492): Xaa can be Gly, Ala, Val, Ile, Leu, Phe, Tyr, Trp, Lys, Arg, Asp, Glu or Ser
  VARIANT (497)..(497): Xaa can be Gly, Ala, Val, Ile, Leu, Phe, Tyr, Trp, Lys, Arg, Asp, Glu or Ser
  VARIANT (502)..(502): Xaa can be Gly, Ala, Val, Ile, Leu, Phe, Tyr, Trp, Lys, Arg, Asp, Glu or Ser
  VARIANT (507)..(507): Xaa can be Gly, Ala, Val, Ile, Leu, Phe, Tyr, Trp, Lys, Arg, Asp, Glu or Ser
  VARIANT (512)..(512): Xaa can be Gly, Ala, Val, Ile, Leu, Phe, Tyr, Trp, Lys, Arg, Asp, Glu or Ser
  VARIANT (517)..(517): Xaa can be Gly, Ala, Val, Ile, Leu, Phe, Tyr, Trp, Lys, Arg, Asp, Glu or Ser
  VARIANT (522)..(522): Xaa can be Gly, Ala, Val, Ile, Leu, Phe, Tyr, Trp, Lys, Arg, Asp, Glu or Ser
  VARIANT (527)..(527): Xaa can be Gly, Ala, Val, Ile, Leu, Phe, Tyr, Trp, Lys, Arg, Asp, Glu or Ser
  VARIANT (532)..(532): Xaa can be Gly, Ala, Val, Ile, Leu, Phe, Tyr, Trp, Lys, Arg, Asp, Glu or Ser
  VARIANT (537)..(537): Xaa can be Gly, Ala, Val, Ile, Leu, Phe, Tyr, Trp, Lys, Arg, Asp, Glu or Ser
  VARIANT (542)..(542): Xaa can be Gly, Ala, Val, Ile, Leu, Phe, Tyr, Trp, Lys, Arg, Asp, Glu or Ser
  VARIANT (547)..(547): Xaa can be Gly, Ala, Val, Ile, Leu, Phe, Tyr, Trp, Lys, Arg, Asp, Glu or Ser
  VARIANT (552)..(552): Xaa can be Gly, Ala, Val, Ile, Leu, Phe, Tyr, Trp, Lys, Arg, Asp, Glu or Ser
  VARIANT (557)..(557): Xaa can be Gly, Ala, Val, Ile, Leu, Phe, Tyr, Trp, Lys, Arg, Asp, Glu or Ser
  VARIANT (562)..(562): Xaa can be Gly, Ala, Val, Ile, Leu, Phe, Tyr, Trp, Lys, Arg, Asp, Glu or Ser
  VARIANT (567)..(567): Xaa can be Gly, Ala, Val, Ile, Leu, Phe, Tyr, Trp, Lys, Arg, Asp, Glu or Ser
  VARIANT (572)..(572): Xaa can be Gly, Ala, Val, Ile, Leu, Phe, Tyr, Trp, Lys, Arg, Asp, Glu or Ser
  VARIANT (577)..(577): Xaa can be Gly, Ala, Val, Ile, Leu, Phe, Tyr, Trp, Lys, Arg, Asp, Glu or Ser
  VARIANT (582)..(582): Xaa can be Gly, Ala, Val, Ile, Leu, Phe, Tyr, Trp, Lys, Arg, Asp, Glu or Ser
  VARIANT (587)..(587): Xaa can be Gly, Ala, Val, Ile, Leu, Phe, Tyr, Trp, Lys, Arg, Asp, Glu or Ser
  VARIANT (592)..(592): Xaa can be Gly, Ala, Val, Ile, Leu, Phe, Tyr, Trp, Lys, Arg, Asp, Glu or Ser
  VARIANT (597)..(597): Xaa can be Gly, Ala, Val, Ile, Leu, Phe, Tyr, Trp, Lys, Arg, Asp, Glu or Ser
  VARIANT (602)..(602): Xaa can be Gly, Ala, Val, Ile, Leu, Phe, Tyr, Trp, Lys, Arg, Asp, Glu or Ser
  VARIANT (607)..(607): Xaa can be Gly, Ala, Val, Ile, Leu, Phe, Tyr, Trp, Lys, Arg, Asp, Glu or Ser
  VARIANT (612)..(612): Xaa can be Gly, Ala, Val, Ile, Leu, Phe, Tyr, Trp, Lys, Arg, Asp, Glu or Ser
  VARIANT (617)..(617): Xaa can be Gly, Ala, Val, Ile, Leu, Phe, Tyr, Trp, Lys, Arg, Asp, Glu or Ser
  VARIANT (622)..(622): Xaa can be Gly, Ala, Val, Ile, Leu, Phe, Tyr, Trp, Lys, Arg, Asp, Glu or Ser
  VARIANT (627)..(627): Xaa can be Gly, Ala, Val, Ile, Leu, Phe, Tyr, Trp, Lys, Arg, Asp, Glu or Ser
  VARIANT (632)..(632): Xaa can be Gly, Ala, Val, Ile, Leu, Phe, Tyr, Trp, Lys, Arg, Asp, Glu or Ser
  VARIANT (637)..(637): Xaa can be Gly, Ala, Val, Ile, Leu, Phe, Tyr, Trp, Lys, Arg, Asp, Glu or Ser
  VARIANT (642)..(642): Xaa can be Gly, Ala, Val, Ile, Leu, Phe, Tyr, Trp, Lys, Arg, Asp, Glu or Ser
  VARIANT (647)..(647): Xaa can be Gly, Ala, Val, Ile, Leu, Phe, Tyr, Trp, Lys, Arg, Asp, Glu or Ser
  VARIANT (652)..(652): Xaa can be Gly, Ala, Val, Ile, Leu, Phe, Tyr, Trp, Lys, Arg, Asp, Glu or Ser
  VARIANT (657)..(657): Xaa can be Gly, Ala, Val, Ile, Leu, Phe, Tyr, Trp, Lys, Arg, Asp, Glu or Ser
  VARIANT (662)..(662): Xaa can be Gly, Ala, Val, Ile, Leu, Phe, Tyr, Trp, Lys, Arg, Asp, Glu or Ser
  VARIANT (667)..(667): Xaa can be Gly, Ala, Val, Ile, Leu, Phe, Tyr, Trp, Lys, Arg, Asp, Glu or Ser
  VARIANT (672)..(672): Xaa can be Gly, Ala, Val, Ile, Leu, Phe, Tyr, Trp, Lys, Arg, Asp, Glu or Ser
  VARIANT (677)..(677): Xaa can be Gly, Ala, Val, Ile, Leu, Phe, Tyr, Trp, Lys, Arg, Asp, Glu or Ser
  VARIANT (682)..(682): Xaa can be Gly, Ala, Val, Ile, Leu, Phe, Tyr, Trp, Lys, Arg, Asp, Glu or Ser
  VARIANT (687)..(687): Xaa can be Gly, Ala, Val, Ile, Leu, Phe, Tyr, Trp, Lys, Arg, Asp, Glu or Ser
  VARIANT (692)..(692): Xaa can be Gly, Ala, Val, Ile, Leu, Phe, Tyr, Trp, Lys, Arg, Asp, Glu or Ser
  VARIANT (697)..(697): Xaa can be Gly, Ala, Val, Ile, Leu, Phe, Tyr, Trp, Lys, Arg, Asp, Glu or Ser
  VARIANT (702)..(702): Xaa can be Gly, Ala, Val, Ile, Leu, Phe, Tyr, Trp, Lys, Arg, Asp, Glu or Ser
  VARIANT (707)..(707): Xaa can be Gly, Ala, Val, Ile, Leu, Phe, Tyr, Trp, Lys, Arg, Asp, Glu or Ser
  VARIANT (712)..(712): Xaa can be Gly, Ala, Val, Ile, Leu, Phe, Tyr, Trp, Lys, Arg, Asp, Glu or Ser
  VARIANT (717)..(717): Xaa can be Gly, Ala, Val, Ile, Leu, Phe, Tyr, Trp, Lys, Arg, Asp, Glu or Ser
  VARIANT (722)..(722): Xaa can be Gly, Ala, Val, Ile, Leu, Phe, Tyr, Trp, Lys, Arg, Asp, Glu or Ser
  VARIANT (727)..(727): Xaa can be Gly, Ala, Val, Ile, Leu, Phe, Tyr, Trp, Lys, Arg, Asp, Glu or Ser
  VARIANT (732)..(732): Xaa can be Gly, Ala, Val, Ile, Leu, Phe, Tyr, Trp, Lys, Arg, Asp, Glu or Ser
  VARIANT (737)..(737): Xaa can be Gly, Ala, Val, Ile, Leu, Phe, Tyr, Trp, Lys, Arg, Asp, Glu or Ser
  VARIANT (742)..(742): Xaa can be Gly, Ala, Val, Ile, Leu, Phe, Tyr, Trp, Lys, Arg, Asp, Glu or Ser
  VARIANT (747)..(747): Xaa can be Gly, Ala, Val, Ile, Leu, Phe, Tyr, Trp, Lys, Arg, Asp, Glu or Ser
  VARIANT (752)..(752): Xaa can be Gly, Ala, Val, Ile, Leu, Phe, Tyr, Trp, Lys, Arg, Asp, Glu or Ser
  VARIANT (757)..(757): Xaa can be Gly, Ala, Val, Ile, Leu, Phe, Tyr, Trp, Lys, Arg, Asp, Glu or Ser
  VARIANT (762)..(762): Xaa can be Gly, Ala, Val, Ile, Leu, Phe, Tyr, Trp, Lys, Arg, Asp, Glu or Ser
  VARIANT (767)..(767): Xaa can be Gly, Ala, Val, Ile, Leu, Phe, Tyr, Trp, Lys, Arg, Asp, Glu or Ser
  VARIANT (772)..(772): Xaa can be Gly, Ala, Val, Ile, Leu, Phe, Tyr, Trp, Lys, Arg, Asp, Glu or Ser
  VARIANT (777)..(777): Xaa can be Gly, Ala, Val, Ile, Leu, Phe, Tyr, Trp, Lys, Arg, Asp, Glu or Ser
  VARIANT (782)..(782): Xaa can be Gly, Ala, Val, Ile, Leu, Phe, Tyr, Trp, Lys, Arg, Asp, Glu or Ser
  VARIANT (787)..(787): Xaa can be Gly, Ala, Val, Ile, Leu, Phe, Tyr, Trp, Lys, Arg, Asp, Glu or Ser
  VARIANT (792)..(792): Xaa can be Gly, Ala, Val, Ile, Leu, Phe, Tyr, Trp, Lys, Arg, Asp, Glu or Ser
  VARIANT (797)..(797): Xaa can be Gly, Ala, Val, Ile, Leu, Phe, Tyr, Trp, Lys, Arg, Asp, Glu or Ser
GXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVP

SEQ ID NO: 148 - protein, 1440 aa, Artificial Sequence
  elastin-like polypeptide
  VARIANT (1)..(1): Xaa can be any naturally occurring amino acid
  VARIANT (2)..(2): Xaa can be any naturally occurring amino acid
  VARIANT (4)..(4): Xaa can be any naturally occurring amino acid except Pro or Gly
  VARIANT (5)..(5): Xaa can be any naturally occurring amino acid except Pro or Gly
  VARIANT (6)..(6): Xaa can be any naturally occurring amino acid except Pro or Gly
  VARIANT (7)..(7): Xaa can be any naturally occurring amino acid except Pro or Gly
  VARIANT (9)..(9): Xaa can be any naturally occurring amino acid
  VARIANT (10)..(10): Xaa can be any naturally occurring amino acid
  VARIANT (11)..(11): Xaa can be any naturally occurring amino acid
  VARIANT (13)..(13): Xaa can be any naturally occurring amino acid except Pro or Gly
  VARIANT (14)..(14): Xaa can be any naturally occurring amino acid except Pro or Gly
  VARIANT (15)..(15): Xaa can be any naturally occurring amino acid except Pro or Gly
  VARIANT (16)..(16): Xaa can be any naturally occurring amino acid except Pro or Gly
  VARIANT (18)..(18): Xaa can be any naturally occurring amino acid
  VARIANT (19)..(19): Xaa can be any naturally occurring amino acid
  VARIANT (20)..(20): Xaa can be any naturally occurring amino acid
  VARIANT (22)..(22): Xaa can be any naturally occurring amino acid except Pro or Gly
  VARIANT (23)..(23): Xaa can be any naturally occurring amino acid except Pro or Gly
  VARIANT (24)..(24): Xaa can be any naturally occurring amino acid except Pro or Gly
  VARIANT (25)..(25): Xaa can be any naturally occurring amino acid except Pro or Gly
  VARIANT (27)..(27): Xaa can be any naturally occurring amino acid
  VARIANT (28)..(28): Xaa can be any naturally occurring amino acid
  VARIANT (29)..(29): Xaa can be any naturally occurring amino acid
  VARIANT (31)..(31): Xaa can be any naturally occurring amino acid except Pro or Gly
  VARIANT (32)..(32): Xaa can be any naturally occurring amino acid except Pro or Gly
  VARIANT (33)..(33): Xaa can be any naturally occurring amino acid except Pro or Gly
  VARIANT (34)..(34): Xaa can be any naturally occurring amino acid except Pro or Gly
  VARIANT (36)..(36): Xaa can be any naturally occurring amino acid
  VARIANT (37)..(37): Xaa can be any naturally occurring amino acid
  VARIANT (38)..(38): Xaa can be any naturally occurring amino acid
  VARIANT (40)..(40): Xaa can be any naturally occurring amino acid except Pro or Gly
  VARIANT (41)..(41): Xaa can be any naturally occurring amino acid except Pro or Gly
  VARIANT (42)..(42): Xaa can be any naturally occurring amino acid except Pro or Gly
  VARIANT (43)..(43): Xaa can be any naturally occurring amino acid except Pro or Gly
  VARIANT (45)..(45): Xaa can be any naturally occurring amino acid
  VARIANT (46)..(46): Xaa can be any naturally occurring amino acid
  VARIANT (47)..(47): Xaa can be any naturally occurring amino acid
  VARIANT (49)..(49): Xaa can be any naturally occurring amino acid except Pro or Gly
  VARIANT (50)..(50): Xaa can be any naturally occurring amino acid except Pro or Gly
  VARIANT (51)..(51): Xaa can be any naturally occurring amino acid except Pro or Gly
  VARIANT (52)..(52): Xaa can be any naturally occurring amino acid except Pro or Gly
  VARIANT (54)..(54): Xaa can be any naturally occurring amino acid
  VARIANT (55)..(55): Xaa can be any naturally occurring amino acid
  VARIANT (56)..(56): Xaa can be any naturally occurring amino acid
  VARIANT (58)..(58): Xaa can be any naturally occurring amino acid except Pro or Gly
  VARIANT (59)..(59): Xaa can be any naturally occurring amino acid except Pro or Gly
  VARIANT (60)..(60): Xaa can be any naturally occurring amino acid except Pro or Gly
  VARIANT (61)..(61): Xaa can be any naturally occurring amino acid except Pro or Gly
  VARIANT (63)..(63): Xaa can be any naturally occurring amino acid
  VARIANT (64)..(64): Xaa can be any naturally occurring amino acid
  VARIANT (65)..(65): Xaa can be any naturally occurring amino acid
  VARIANT (67)..(67): Xaa can be any naturally occurring amino acid except Pro or Gly
  VARIANT (68)..(68): Xaa can be any naturally occurring amino acid except Pro or Gly
  VARIANT (69)..(69): Xaa can be any naturally occurring amino acid except Pro or Gly
  VARIANT (70)..(70): Xaa can be any naturally occurring amino acid except Pro or Gly
  VARIANT (72)..(72): Xaa can be any naturally occurring amino acid
  VARIANT (73)..(73): Xaa can be any naturally occurring amino acid
  VARIANT (74)..(74): Xaa can be any naturally occurring amino acid
  VARIANT (76)..(76): Xaa can be any naturally occurring amino acid except Pro or Gly
  VARIANT (77)..(77): Xaa can be any naturally occurring amino acid except Pro or Gly
  VARIANT (78)..(78): Xaa can be any naturally occurring amino acid except Pro or Gly
  VARIANT (79)..(79): Xaa can be any naturally occurring amino acid except Pro or Gly
  VARIANT (81)..(81): Xaa can be any naturally occurring amino acid
  VARIANT (82)..(82): Xaa can be any naturally occurring amino acid
  VARIANT (83)..(83): Xaa can be any naturally occurring amino acid
  VARIANT (85)..(85): Xaa can be any naturally occurring amino acid except Pro or Gly
  VARIANT (86)..(86): Xaa can be any naturally occurring amino acid except Pro or Gly
  VARIANT (87)..(87): Xaa can be any naturally occurring amino acid except Pro or Gly
  VARIANT (88)..(88): Xaa can be any naturally occurring amino acid except Pro or Gly
  VARIANT (90)..(90): Xaa can be any naturally occurring amino acid
  VARIANT (91)..(1440): May be present or absent in groups of the repeat unit Xaa Xaa Pro Xaa Xaa Xaa Xaa Gly Xaa
  VARIANT (91)..(91): Xaa can be any naturally occurring amino acid
  VARIANT (92)..(92): Xaa can be any naturally occurring amino acid
  VARIANT (94)..(94): Xaa can be any naturally occurring amino acid except Pro or Gly
  VARIANT (95)..(95): Xaa can be any naturally occurring amino acid except Pro or Gly
  VARIANT (96)..(96): Xaa can be any naturally occurring amino acid except Pro or Gly
  VARIANT (97)..(97): Xaa can be any naturally occurring amino acid except Pro or Gly
  VARIANT (99)..(99): Xaa can be any naturally occurring amino acid
  VARIANT (100)..(100): Xaa can be any naturally occurring amino acid
  VARIANT (101)..(101): Xaa can be any naturally occurring amino acid
  VARIANT (103)..(103): Xaa can be any naturally occurring amino acid except Pro or Gly
  VARIANT (104)..(104): Xaa can be any naturally occurring amino acid except Pro or Gly
  VARIANT (105)..(105): Xaa can be any naturally occurring amino acid except Pro or Gly
  VARIANT (106)..(106): Xaa can be any naturally occurring amino acid except Pro or Gly
  VARIANT (108)..(108): Xaa can be any naturally occurring amino acid
  VARIANT (109)..(109): Xaa can be any naturally occurring amino acid
  VARIANT (110)..(110): Xaa can be any naturally occurring amino acid
  VARIANT (112)..(112): Xaa can be any naturally occurring amino acid except Pro or Gly
  VARIANT (113)..(113): Xaa can be any naturally occurring amino acid except Pro or Gly
  VARIANT (114)..(114): Xaa can be any naturally occurring amino acid except Pro or Gly
  VARIANT (115)..(115): Xaa can be any naturally occurring amino acid except Pro or Gly
  VARIANT (117)..(117): Xaa can be any naturally occurring amino acid
  VARIANT (118)..(118): Xaa can be any naturally occurring amino acid
  VARIANT (119)..(119): Xaa can be any naturally occurring amino acid
  VARIANT (121)..(121): Xaa can be any naturally occurring amino acid except Pro or Gly
  VARIANT (122)..(122): Xaa can be any naturally occurring amino acid except Pro or Gly
  VARIANT (123)..(123): Xaa can be any naturally occurring amino acid except Pro or Gly
  VARIANT (124)..(124): Xaa can be any naturally occurring amino acid except Pro or Gly
  VARIANT (126)..(126): Xaa can be any naturally occurring amino acid
  VARIANT (127)..(127): Xaa can be any naturally occurring amino acid
  VARIANT (128)..(128): Xaa can be any naturally occurring amino acid
  VARIANT (130)..(130): Xaa can be any naturally occurring amino acid except Pro or Gly
  VARIANT (131)..(131): Xaa can be any naturally occurring amino acid except Pro or Gly
  VARIANT (132)..(132): Xaa can be any naturally occurring amino acid except Pro or Gly
  VARIANT (133)..(133): Xaa can be any naturally occurring amino acid except Pro or Gly
  VARIANT (135)..(135): Xaa can be any naturally occurring amino acid
  VARIANT (136)..(136): Xaa can be any naturally occurring amino acid
  VARIANT (137)..(137): Xaa can be any naturally occurring amino acid
  VARIANT (139)..(139): Xaa can be any naturally occurring amino acid except Pro or Gly
  VARIANT (140)..(140): Xaa can be any naturally occurring amino acid except Pro or Gly
  VARIANT (141)..(141): Xaa can be any naturally occurring amino acid except Pro or Gly
  VARIANT (142)..(142): Xaa can be any naturally occurring amino acid except Pro or Gly
  VARIANT (144)..(144): Xaa can be any naturally occurring amino acid
  VARIANT (145)..(145): Xaa can be any naturally occurring amino acid
  VARIANT (146)..(146): Xaa can be any naturally occurring amino acid
  VARIANT (148)..(148): Xaa can be any naturally occurring amino acid except Pro or Gly
  VARIANT (149)..(149): Xaa can be any naturally occurring amino acid except Pro or Gly
  VARIANT (150)..(150): Xaa can be any naturally occurring amino acid except Pro or Gly
  VARIANT (151)..(151): Xaa can be any naturally occurring amino acid except Pro or Gly
  VARIANT (153)..(153): Xaa can be any naturally occurring amino acid
  VARIANT (154)..(154): Xaa can be any naturally occurring amino acid
  VARIANT (155)..(155): Xaa can be any naturally occurring amino acid
  VARIANT (157)..(157): Xaa can be any naturally occurring amino acid except Pro or Gly
  VARIANT (158)..(158): Xaa can be any naturally occurring amino acid except Pro or Gly
  VARIANT (159)..(159): Xaa can be any naturally occurring amino acid except Pro or Gly
  VARIANT (160)..(160): Xaa can be any naturally occurring amino acid except Pro or Gly
  VARIANT (162)..(162): Xaa can be any naturally occurring amino acid
  VARIANT (163)..(163): Xaa can be any naturally occurring amino acid
  VARIANT (164)..(164): Xaa can be any naturally occurring amino acid
  VARIANT (166)..(166): Xaa can be any naturally occurring amino acid except Pro or Gly
  VARIANT (167)..(167): Xaa can be any naturally occurring amino acid except Pro or Gly
  VARIANT (168)..(168): Xaa can be any naturally occurring amino acid except Pro or Gly
  VARIANT (169)..(169): Xaa can be any naturally occurring amino acid except Pro or Gly
  VARIANT (171)..(171): Xaa can be any naturally occurring amino acid
  VARIANT (172)..(172): Xaa can be any naturally occurring amino acid
  VARIANT (173)..(173): Xaa can be any naturally occurring amino acid
  VARIANT (175)..(175): Xaa can be any naturally occurring amino acid except Pro or Gly
  VARIANT (176)..(176): Xaa can be any naturally occurring amino acid except Pro or Gly
  VARIANT (177)..(177): Xaa can be any naturally occurring amino acid except Pro or Gly
  VARIANT (178)..(178): Xaa can be any naturally occurring amino acid except Pro or Gly
  VARIANT (180)..(180): Xaa can be any naturally occurring amino acid
  VARIANT (181)..(181): Xaa can be any naturally occurring amino acid
  VARIANT (182)..(182): Xaa can be any naturally occurring amino acid
  VARIANT (184)..(184): Xaa can be any naturally occurring amino acid except Pro or Gly
  VARIANT (185)..(185): Xaa can be any naturally occurring amino acid except Pro or Gly
  VARIANT (186)..(186): Xaa can be any naturally occurring amino acid except Pro or Gly
  VARIANT (187)..(187): Xaa can be any naturally occurring amino acid except Pro or Gly
  VARIANT (189)..(189): Xaa can be any naturally occurring amino acid
  VARIANT (190)..(190): Xaa can be any naturally occurring amino acid
  VARIANT (191)..(191): Xaa can be any naturally occurring amino acid
  VARIANT (193)..(193): Xaa can be any naturally occurring amino acid except Pro or Gly
  VARIANT (194)..(194): Xaa can be any naturally occurring amino acid except Pro or Gly
  VARIANT (195)..(195): Xaa can be any naturally occurring amino acid except Pro or Gly
  VARIANT (196)..(196): Xaa can be any naturally occurring amino acid except Pro or Gly
  VARIANT (198)..(198): Xaa can be any naturally occurring amino acid
  VARIANT (199)..(199): Xaa can be any naturally occurring amino acid
  VARIANT (200)..(200): Xaa can be any naturally occurring amino acid
  VARIANT (202)..(202): Xaa can be any naturally occurring amino acid except Pro or Gly
  VARIANT (203)..(203): Xaa can be any naturally occurring amino acid except Pro or Gly
  VARIANT (204)..(204): Xaa can be any naturally occurring amino acid except Pro or Gly
  VARIANT (205)..(205): Xaa can be any naturally occurring amino acid except Pro or Gly
  VARIANT (207)..(207): Xaa can be any naturally occurring amino acid
  VARIANT (208)..(208): Xaa can be any naturally occurring amino acid
  VARIANT (209)..(209): Xaa can be any naturally occurring amino acid
  VARIANT (211)..(211): Xaa can be any naturally occurring amino acid except Pro or Gly
  VARIANT (212)..(212): Xaa can be any naturally occurring amino acid except Pro or Gly
  VARIANT (213)..(213): Xaa can be any naturally occurring amino acid except Pro or Gly
  VARIANT (214)..(214): Xaa can be any naturally occurring amino acid except Pro or Gly
  VARIANT (216)..(216): Xaa can be any naturally occurring amino acid
  VARIANT (217)..(217): Xaa can be any naturally occurring amino acid
  VARIANT (218)..(218): Xaa can be any naturally occurring amino acid
  VARIANT (220)..(220): Xaa can be any naturally occurring amino acid except Pro or Gly
  VARIANT (221)..(221): Xaa can be any naturally occurring amino acid except Pro or Gly
  VARIANT (222)..(222): Xaa can be any naturally occurring amino acid except Pro or Gly
  VARIANT (223)..(223): Xaa can be any naturally occurring amino acid except Pro or Gly
  VARIANT (225)..(225): Xaa can be any naturally occurring amino acid
  VARIANT (226)..(226): Xaa can be any naturally occurring amino acid
  VARIANT (227)..(227): Xaa can be any naturally occurring amino acid
  VARIANT (229)..(229): Xaa can be any naturally occurring amino acid except Pro or Gly
  VARIANT (230)..(230): Xaa can be any naturally occurring amino acid except Pro or Gly
  VARIANT (231)..(231): Xaa can be any naturally occurring amino acid except Pro or Gly
  VARIANT (232)..(232): Xaa can be any naturally occurring amino acid except Pro or Gly
  VARIANT (234)..(234): Xaa can be any naturally occurring amino acid
  VARIANT (235)..(235): Xaa can be any naturally occurring amino acid
  VARIANT (236)..(236): Xaa can be any naturally occurring amino acid
  VARIANT (238)..(238): Xaa can be any naturally occurring amino acid except Pro or Gly
  VARIANT (239)..(239): Xaa can be any naturally occurring amino acid except Pro or Gly
  VARIANT (240)..(240): Xaa can be any naturally occurring amino acid except Pro or Gly
  VARIANT (241)..(241): Xaa can be any naturally occurring amino acid except Pro or Gly
  VARIANT (243)..(243): Xaa can be any naturally occurring amino acid
  VARIANT (244)..(244): Xaa can be any naturally occurring amino acid
  VARIANT (245)..(245): Xaa can be any naturally occurring amino acid
  VARIANT (247)..(247): Xaa can be any naturally occurring amino acid except Pro or Gly
  VARIANT (248)..(248): Xaa can be any naturally occurring amino acid except Pro or Gly
  VARIANT (249)..(249): Xaa can be any naturally occurring amino acid except Pro or Gly
  VARIANT (250)..(250): Xaa can be any naturally occurring amino acid except Pro or Gly
  VARIANT (252)..(252): Xaa can be any naturally occurring amino acid
  VARIANT (253)..(253): Xaa can be any naturally occurring amino acid
  VARIANT (254)..(254): Xaa can be any naturally occurring amino acid
  VARIANT (256)..(256): Xaa can be any naturally occurring amino acid except Pro or Gly
  VARIANT (257)..(257): Xaa can be any naturally occurring amino acid except Pro or Gly
  VARIANT (258)..(258): Xaa can be any naturally occurring amino acid except Pro or Gly
  VARIANT (259)..(259): Xaa can be any naturally occurring amino acid except Pro or Gly
  VARIANT (261)..(261): Xaa can be any naturally occurring amino acid
  VARIANT (262)..(262): Xaa can be any naturally occurring amino acid
  VARIANT (263)..(263): Xaa can be any naturally occurring amino acid
  VARIANT (265)..(265): Xaa can be any naturally occurring amino acid except Pro or Gly
  VARIANT (266)..(266): Xaa can be any naturally occurring amino acid except Pro or Gly
  VARIANT (267)..(267): Xaa can be any naturally occurring amino acid except Pro or Gly
  VARIANT (268)..(268): Xaa can be any naturally occurring amino acid except Pro or Gly
  VARIANT (270)..(270): Xaa can be any naturally occurring amino acid
  VARIANT (271)..(271): Xaa can be any naturally occurring amino acid
  VARIANT (272)..(272): Xaa can be any naturally occurring amino acid
  VARIANT (274)..(274): Xaa can be any naturally occurring amino acid except Pro or Gly
  VARIANT (275)..(275): Xaa can be any naturally occurring amino acid except Pro or Gly
  VARIANT (276)..(276): Xaa can be any naturally occurring amino acid except Pro or Gly
  VARIANT (277)..(277): Xaa can be any naturally occurring amino acid except Pro or Gly
  VARIANT (279)..(279): Xaa can be any naturally occurring amino acid
  VARIANT (280)..(280): Xaa can be any naturally occurring amino acid
  VARIANT (281)..(281): Xaa can be any naturally occurring amino acid
  VARIANT (283)..(283): Xaa can be any naturally occurring amino acid except Pro or Gly
  VARIANT (284)..(284): Xaa can be any naturally occurring amino acid except Pro or Gly
  VARIANT (285)..(285): Xaa can be any naturally occurring amino acid except Pro or Gly
  VARIANT (286)..(286): Xaa can be any naturally occurring amino acid except Pro or Gly
  VARIANT (288)..(288): Xaa can be any naturally occurring amino acid
  VARIANT (289)..(289): Xaa can be any naturally occurring amino acid
  VARIANT (290)..(290): Xaa can be any naturally occurring amino acid
  VARIANT (292)..(292): Xaa can be any naturally occurring amino acid except Pro or Gly
  VARIANT (293)..(293): Xaa can be any naturally occurring amino acid except Pro or Gly
  VARIANT (294)..(294): Xaa can be any naturally occurring amino acid except Pro or Gly
  VARIANT (295)..(295): Xaa can be any naturally occurring amino acid except Pro or Gly
  VARIANT (297)..(297): Xaa can be any naturally occurring amino acid
  VARIANT (298)..(298): Xaa can be any naturally occurring amino acid
  VARIANT (299)..(299): Xaa can be any naturally occurring amino acid
  VARIANT (301)..(301): Xaa can be any naturally occurring amino acid except Pro or Gly
  VARIANT (302)..(302): Xaa can be any naturally occurring amino acid except Pro or Gly
  VARIANT (303)..(303): Xaa can be any naturally occurring amino acid except Pro or Gly
  VARIANT (304)..(304): Xaa can be any naturally occurring amino acid except Pro or Gly
  VARIANT (306)..(306): Xaa can be any naturally occurring amino acid
  VARIANT (307)..(307): Xaa can be any naturally occurring amino acid
  VARIANT (308)..(308): Xaa can be any naturally occurring amino acid
  VARIANT (310)..(310): Xaa can be any naturally occurring amino acid except Pro or Gly
  VARIANT (311)..(311): Xaa can be any naturally occurring amino acid except Pro or Gly
  VARIANT (312)..(312): Xaa can be any naturally occurring amino acid except Pro or Gly
  VARIANT (313)..(313): Xaa can be any naturally occurring amino acid except Pro or Gly
  VARIANT (315)..(315): Xaa can be any naturally occurring amino acid
  VARIANT (316)..(316): Xaa can be any naturally occurring amino acid
  VARIANT (317)..(317): Xaa can be any naturally occurring amino acid
  VARIANT (319)..(319): Xaa can be any naturally occurring amino acid except Pro or Gly
  VARIANT (320)..(320): Xaa can be any naturally occurring amino acid except Pro or Gly
  VARIANT (321)..(321): Xaa can be any naturally occurring amino acid except Pro or Gly
  VARIANT (322)..(322): Xaa can be any naturally occurring amino acid except Pro or Gly
  VARIANT (324)..(324): Xaa can be any naturally occurring amino acid
  VARIANT (325)..(325): Xaa can be any naturally occurring amino acid
  VARIANT (326)..(326): Xaa can be any naturally occurring amino acid
  VARIANT (328)..(328): Xaa can be any naturally occurring amino acid except Pro or Gly
  VARIANT (329)..(329): Xaa can be any naturally occurring amino acid except Pro or Gly
  VARIANT (330)..(330): Xaa can be any naturally occurring amino acid except Pro or Gly
  VARIANT (331)..(331): Xaa can be any naturally occurring amino acid except Pro or Gly
  VARIANT (333)..(333): Xaa can be any naturally occurring amino acid
  VARIANT (334)..(334): Xaa can be any naturally occurring amino acid
  VARIANT (335)..(335): Xaa can be any naturally occurring amino acid
  VARIANT (337)..(337): Xaa can be any naturally occurring amino acid except Pro or Gly
  VARIANT (338)..(338): Xaa can be any naturally occurring amino acid except Pro or Gly
  VARIANT (339)..(339): Xaa can be any naturally occurring amino acid except Pro or Gly
  VARIANT (340)..(340): Xaa can be any naturally occurring amino acid except Pro or Gly
  VARIANT (342)..(342): Xaa can be any naturally occurring amino acid
  VARIANT (343)..(343): Xaa can be any naturally occurring amino acid
  VARIANT (344)..(344): Xaa can be any naturally occurring amino acid
  VARIANT (346)..(346): Xaa can be any naturally occurring amino acid except Pro or Gly
  VARIANT (347)..(347): Xaa can be any naturally occurring amino acid except Pro or Gly
  VARIANT (348)..(348): Xaa can be any naturally occurring amino acid except Pro or Gly
  VARIANT (349)..(349): Xaa can be any naturally occurring amino acid except Pro or Gly
  VARIANT (351)..(351): Xaa can be any naturally occurring amino acid
  VARIANT (352)..(352): Xaa can be any naturally occurring amino acid
  VARIANT (353)..(353): Xaa can be any naturally occurring amino acid
  VARIANT (355)..(355): Xaa can be any naturally occurring amino acid except Pro or Gly
  VARIANT (356)..(356): Xaa can be any naturally occurring amino acid except Pro or Gly
  VARIANT (357)..(357): Xaa can be any naturally occurring amino acid except Pro or Gly
  VARIANT (358)..(358): Xaa can be any naturally occurring amino acid except Pro or Gly
  VARIANT (360)..(360): Xaa can be any naturally occurring amino acid
  VARIANT (361)..(361): Xaa can be any naturally occurring amino acid
  VARIANT (362)..(362): Xaa can be any naturally occurring amino acid
  VARIANT (364)..(364): Xaa can be any naturally occurring amino acid except Pro or Gly
  VARIANT (365)..(365): Xaa can be any naturally occurring amino acid except Pro or Gly
  VARIANT (366)..(366): Xaa can be any naturally occurring amino acid except Pro or Gly
  VARIANT (367)..(367): Xaa can be any naturally occurring amino acid except Pro or Gly
  VARIANT (369)..(369): Xaa can be any naturally occurring amino acid
  VARIANT (370)..(370): Xaa can be any naturally occurring amino acid
  VARIANT (371)..(371): Xaa can be any naturally occurring amino acid
  VARIANT (373)..(373): Xaa can be any naturally occurring amino acid except Pro or Gly
  VARIANT (374)..(374): Xaa can be any naturally occurring amino acid except Pro or Gly
  VARIANT (375)..(375): Xaa can be any naturally occurring amino acid except Pro or Gly
  VARIANT (376)..(376): Xaa can be any naturally occurring amino acid except Pro or Gly
  VARIANT (378)..(378): Xaa can be any naturally occurring amino acid
  VARIANT (379)..(379): Xaa can be any naturally occurring amino acid
  VARIANT (380)..(380): Xaa can be any naturally occurring amino acid
  VARIANT (382)..(382): Xaa can be any naturally occurring amino acid except Pro or Gly
  VARIANT (383)..(383): Xaa can be any naturally occurring amino acid except Pro or Gly
  VARIANT (384)..(384): Xaa can be any naturally occurring amino acid except Pro or Gly
  VARIANT (385)..(385): Xaa can be any naturally occurring amino acid except Pro or Gly
  VARIANT (387)..(387): Xaa can be any naturally occurring amino acid
  VARIANT (388)..(388): Xaa can be any naturally occurring amino acid
  VARIANT (389)..(389): Xaa can be any naturally occurring amino acid
  VARIANT (391)..(391): Xaa can be any naturally occurring amino acid except Pro or Gly
  VARIANT (392)..(392): Xaa can be any naturally occurring amino acid except Pro or Gly
  VARIANT (393)..(393): Xaa can be any naturally occurring amino acid except Pro or Gly
  VARIANT (394)..(394): Xaa can be any naturally occurring amino acid except Pro or Gly
  VARIANT (396)..(396): Xaa can be any naturally occurring amino acid
  VARIANT (397)..(397): Xaa can be any naturally occurring amino acid
  VARIANT (398)..(398): Xaa can be any naturally occurring amino acid
  VARIANT (400)..(400): Xaa can be any naturally occurring amino acid except Pro or Gly
  VARIANT (401)..(401): Xaa can be any naturally occurring amino acid except Pro or Gly
  VARIANT (402)..(402): Xaa can be any naturally occurring amino acid except Pro or Gly
  VARIANT (403)..(403): Xaa can be any naturally occurring amino acid except Pro or Gly
  VARIANT (405)..(405): Xaa can be any naturally occurring amino acid
  VARIANT (406)..(406): Xaa can be any naturally occurring amino acid
  VARIANT (407)..(407): Xaa can be any naturally occurring amino acid
  VARIANT (409)..(409): Xaa can be any naturally occurring amino acid except Pro or Gly
  VARIANT (410)..(410): Xaa can be any naturally occurring amino acid except Pro or Gly
  VARIANT (411)..(411): Xaa can be any naturally occurring amino acid except Pro or Gly
  VARIANT (412)..(412): Xaa can be any naturally occurring amino acid except Pro or Gly
  VARIANT (414)..(414): Xaa can be any naturally occurring amino acid
  VARIANT (415)..(415): Xaa can be any naturally occurring amino acid
  VARIANT (416)..(416): Xaa can be any naturally occurring amino acid
  VARIANT (418)..(418): Xaa can be any naturally occurring amino acid except Pro or Gly
  VARIANT (419)..(419): Xaa can be any naturally occurring amino acid except Pro or Gly
  VARIANT (420)..(420): Xaa can be any naturally occurring amino acid except Pro or Gly
  VARIANT (421)..(421): Xaa can be any naturally occurring amino acid except Pro or Gly
  VARIANT (423)..(423): Xaa can be any naturally occurring amino acid
  VARIANT (424)..(424): Xaa can be any naturally occurring amino acid
  VARIANT (425)..(425): Xaa can be any naturally occurring amino acid
  VARIANT (427)..(427): Xaa can be any naturally occurring amino acid except Pro or Gly
  VARIANT (428)..(428): Xaa can be any naturally occurring amino acid except Pro or Gly
  VARIANT (429)..(429): Xaa can be any naturally occurring amino acid except Pro or Gly
  VARIANT (430)..(430): Xaa can be any naturally occurring amino acid except Pro or Gly
  VARIANT (432)..(432): Xaa can be any naturally occurring amino acid
  VARIANT (433)..(433): Xaa can be any naturally occurring amino acid
  VARIANT (434)..(434): Xaa can be any naturally occurring amino acid
  VARIANT (436)..(436): Xaa can be any naturally occurring amino acid except Pro or Gly
  VARIANT (437)..(437): Xaa can be any naturally occurring amino acid except Pro or Gly
  VARIANT (438)..(438): Xaa can be any naturally occurring amino acid except Pro or Gly
  VARIANT (439)..(439): Xaa can be any naturally occurring amino acid except Pro or Gly
  VARIANT (441)..(441): Xaa can be any naturally occurring amino acid
  VARIANT (442)..(442): Xaa can be any naturally occurring amino acid
  VARIANT (443)..(443): Xaa can be any naturally occurring amino acid
  VARIANT (445)..(445): Xaa can be any naturally occurring amino acid except Pro or Gly
  VARIANT (446)..(446): Xaa can be any naturally occurring amino acid except Pro or Gly
  VARIANT (447)..(447): Xaa can be any naturally occurring amino acid except Pro or Gly
  VARIANT (448)..(448): Xaa can be any naturally occurring amino acid except Pro or Gly
  VARIANT (450)..(450): Xaa can be any naturally occurring amino acid
  VARIANT (451)..(451): Xaa can be any naturally occurring amino acid
  VARIANT (452)..(452): Xaa can be any naturally occurring amino acid
  VARIANT (454)..(454): Xaa can be any naturally occurring amino acid except Pro or Gly
  VARIANT (455)..(455): Xaa can be any naturally occurring amino acid except Pro or Gly
  VARIANT (456)..(456): Xaa can be any naturally occurring amino acid except Pro or Gly
  VARIANT (457)..(457): Xaa can be any naturally occurring amino acid except Pro or Gly
  VARIANT (459)..(459): Xaa can be any naturally occurring amino acid
  VARIANT (460)..(460): Xaa can be any naturally occurring amino acid
  VARIANT (461)..(461): Xaa can be any naturally occurring amino acid
  VARIANT (463)..(463): Xaa can be any naturally occurring amino acid except Pro or Gly
  VARIANT (464)..(464): Xaa can be any naturally occurring amino acid except Pro or Gly
  VARIANT (465)..(465): Xaa can be any naturally occurring amino acid except Pro or Gly
  VARIANT (466)..(466): Xaa can be any naturally occurring amino acid except Pro or Gly
  VARIANT (468)..(468): Xaa can be any naturally occurring amino acid
  VARIANT (469)..(469): Xaa can be any naturally occurring amino acid
  VARIANT (470)..(470): Xaa can be any naturally occurring amino acid
  VARIANT (472)..(472): Xaa can be any naturally occurring amino acid except Pro or Gly
  VARIANT (473)..(473): Xaa can be any naturally occurring amino acid except Pro or Gly
  VARIANT (474)..(474): Xaa can be any naturally occurring amino acid except Pro or Gly
  VARIANT (475)..(475): Xaa can be any naturally occurring amino acid except Pro or Gly
  VARIANT (477)..(477): Xaa can be any naturally occurring amino acid
  VARIANT (478)..(478): Xaa can be any naturally occurring amino acid
  VARIANT (479)..(479): Xaa can be any naturally occurring amino acid
  VARIANT (481)..(481): Xaa can be any naturally occurring amino acid except Pro or Gly
  VARIANT (482)..(482): Xaa can be any naturally occurring amino acid except Pro or Gly
  VARIANT (483)..(483): Xaa can be any naturally occurring amino acid except Pro or Gly
  VARIANT (484)..(484): Xaa can be any naturally occurring amino acid except Pro or Gly
  VARIANT (486)..(486): Xaa can be any naturally occurring amino acid
  VARIANT (487)..(487): Xaa can be any naturally occurring amino acid
  VARIANT (488)..(488): Xaa can be any naturally occurring amino acid
  VARIANT (490)..(490): Xaa can be any naturally occurring amino acid except Pro or Gly
  VARIANT (491)..(491): Xaa can be any naturally occurring amino acid except Pro or Gly
  VARIANT (492)..(492): Xaa can be any naturally occurring amino acid except Pro or Gly
  VARIANT (493)..(493): Xaa can be any naturally occurring amino acid except Pro or Gly
  VARIANT (495)..(495): Xaa can be any naturally occurring amino acid
  VARIANT (496)..(496): Xaa can be any naturally occurring amino acid
  VARIANT (497)..(497): Xaa can be any naturally occurring amino acid
  VARIANT (499)..(499): Xaa can be any naturally occurring amino acid except Pro or Gly
  VARIANT (500)..(500): Xaa can be any naturally occurring amino acid except Pro or Gly
  VARIANT (501)..(501): Xaa can be any naturally occurring amino acid except Pro or Gly
  VARIANT (502)..(502): Xaa can be any naturally occurring amino acid except Pro or Gly
  VARIANT (504)..(504): Xaa can be any naturally occurring amino acid
  VARIANT (505)..(505): Xaa can be any naturally occurring amino acid
  VARIANT (506)..(506): Xaa can be any naturally occurring amino acid
  VARIANT (508)..(508): Xaa can be any naturally occurring amino acid except Pro or Gly
  VARIANT (509)..(509): Xaa can be any naturally occurring amino acid except Pro or Gly
  VARIANT (510)..(510): Xaa can be any naturally occurring amino acid except Pro or Gly
  VARIANT (511)..(511): Xaa can be any naturally occurring amino acid except Pro or Gly
  VARIANT (513)..(513): Xaa can be any naturally occurring amino acid
  VARIANT (514)..(514): Xaa can be any naturally occurring amino acid
  VARIANT (515)..(515): Xaa can be any naturally occurring amino acid
  VARIANT (517)..(517): Xaa can be any naturally occurring amino acid except Pro or Gly
  VARIANT (518)..(518): Xaa can be any naturally occurring amino acid except Pro or Gly
  VARIANT (519)..(519): Xaa can be any naturally occurring amino acid except Pro or Gly
  VARIANT (520)..(520): Xaa can be any naturally occurring amino acid except Pro or Gly
  VARIANT (522)..(522): Xaa can be any naturally occurring amino acid
  VARIANT (523)..(523): Xaa can be any naturally occurring amino acid
  VARIANT (524)..(524): Xaa can be any naturally occurring amino acid
  VARIANT (526)..(526): Xaa can be any naturally occurring amino acid except Pro or Gly
  VARIANT (527)..(527): Xaa can be any naturally occurring amino acid except Pro or Gly
  VARIANT (528)..(528): Xaa can be any naturally occurring amino acid except Pro or Gly
  VARIANT (529)..(529): Xaa can be any naturally occurring amino acid except Pro or Gly
  VARIANT (531)..(531): Xaa can be any naturally occurring amino acid
  VARIANT (532)..(532): Xaa can be any naturally occurring amino acid
  VARIANT (533)..(533): Xaa can be any naturally occurring amino acid
  VARIANT (535)..(535): Xaa can be any naturally occurring amino acid except Pro or Gly
  VARIANT (536)..(536): Xaa can be any naturally occurring amino acid except Pro or Gly
  VARIANT (537)..(537): Xaa can be any naturally occurring amino acid except Pro or Gly
  VARIANT (538)..(538): Xaa can be any naturally occurring amino acid except Pro or Gly
  VARIANT (540)..(540): Xaa can be any naturally occurring amino acid
  VARIANT (541)..(541): Xaa can be any naturally occurring amino acid
  VARIANT (542)..(542): Xaa can be any naturally occurring amino acid
  VARIANT (544)..(544): Xaa can be any naturally occurring amino acid except Pro or Gly
  VARIANT (545)..(545): Xaa can be any naturally occurring amino acid except Pro or Gly
  VARIANT (546)..(546): Xaa can be any naturally occurring amino acid except Pro or Gly
  VARIANT (547)..(547): Xaa can be any naturally occurring amino acid except Pro or Gly
  VARIANT (549)..(549): Xaa can be any naturally occurring amino acid
  VARIANT (550)..(550): Xaa can be any naturally occurring amino acid
  VARIANT (551)..(551): Xaa can be any naturally occurring amino acid
  VARIANT (553)..(553): Xaa can be any naturally occurring amino acid except Pro or Gly
  VARIANT (554)..(554): Xaa can be any naturally occurring amino acid except Pro or Gly
  VARIANT (555)..(555): Xaa can be any naturally occurring amino acid except Pro or Gly
  VARIANT (556)..(556): Xaa can be any naturally occurring amino acid except Pro or Gly
  VARIANT (558)..(558): Xaa can be any naturally occurring amino acid
  VARIANT (559)..(559): Xaa can be any naturally occurring amino acid
  VARIANT (560)..(560): Xaa can be any naturally occurring amino acid
  VARIANT (562)..(562): Xaa can be any naturally occurring amino acid except Pro or Gly
  VARIANT (563)..(563): Xaa can be any naturally occurring amino acid except Pro or Gly
  VARIANT (564)..(564): Xaa can be any naturally occurring amino acid except Pro or Gly
  VARIANT (565)..(565): Xaa can be any naturally occurring amino acid except Pro or Gly
  VARIANT (567)..(567): Xaa can be any naturally occurring amino acid
  VARIANT (568)..(568): Xaa can be any naturally occurring amino acid
  VARIANT (569)..(569): Xaa can be any naturally occurring amino acid
  VARIANT (571)..(571): Xaa can be any naturally occurring amino acid except Pro or Gly
  VARIANT (572)..(572): Xaa can be any naturally occurring amino acid except Pro or Gly
  VARIANT (573)..(573): Xaa can be any naturally occurring amino acid except Pro or Gly
  VARIANT (574)..(574): Xaa can be any naturally occurring amino acid except Pro or Gly
  VARIANT (576)..(576): Xaa can be any naturally occurring amino acid
  VARIANT (577)..(577): Xaa can be any naturally occurring amino acid
  VARIANT (578)..(578): Xaa can be any naturally occurring amino acid
  VARIANT (580)..(580): Xaa can be any naturally occurring amino acid except Pro or Gly
  VARIANT (581)..(581): Xaa can be any naturally occurring amino acid except Pro or Gly
  VARIANT (582)..(582): Xaa can be any naturally occurring amino acid except Pro or Gly
  VARIANT (583)..(583): Xaa can be any naturally occurring amino acid except Pro or Gly
  VARIANT (585)..(585): Xaa can be any naturally occurring amino acid
  VARIANT (586)..(586): Xaa can be any naturally occurring amino acid
  VARIANT (587)..(587): Xaa can be any naturally occurring amino acid
  VARIANT (589)..(589): Xaa can be any naturally occurring amino acid except Pro or Gly
  VARIANT (590)..(590): Xaa can be any naturally occurring amino acid except Pro or Gly
  VARIANT (591)..(591): Xaa can be any naturally occurring amino acid except Pro or Gly
  VARIANT (592)..(592): Xaa can be any naturally occurring amino acid except Pro or Gly
  VARIANT (594)..(594): Xaa can be any naturally occurring amino acid
  VARIANT (595)..(595): Xaa can be any naturally occurring amino acid
  VARIANT (596)..(596): Xaa can be any naturally occurring amino acid
  VARIANT (598)..(598): Xaa can be any naturally occurring amino acid except Pro or Gly
  VARIANT (599)..(599): Xaa can be any naturally occurring amino acid except Pro or Gly
  VARIANT (600)..(600): Xaa can be any naturally occurring amino acid except Pro or Gly
  VARIANT (601)..(601): Xaa can be any naturally occurring amino acid except Pro or Gly
  VARIANT (603)..(603): Xaa can be any naturally occurring amino acid
  VARIANT (604)..(604): Xaa can be any naturally occurring amino acid
  VARIANT (605)..(605): Xaa can be any naturally occurring amino acid
  VARIANT (607)..(607): Xaa can be any naturally occurring amino acid except Pro or Gly
  VARIANT (608)..(608): Xaa can be any naturally occurring amino acid except Pro or Gly
  VARIANT (609)..(609): Xaa can be any naturally occurring amino acid except Pro or Gly
  VARIANT (610)..(610): Xaa can be any naturally occurring amino acid except Pro or Gly
  VARIANT (612)..(612): Xaa can be any naturally occurring amino acid
  VARIANT (613)..(613): Xaa can be any naturally occurring amino acid
  VARIANT (614)..(614): Xaa can be any naturally occurring amino acid
  VARIANT (616)..(616): Xaa can be any naturally occurring amino acid except Pro or Gly
  VARIANT (617)..(617): Xaa can be any naturally occurring amino acid except Pro or Gly
  VARIANT (618)..(618): Xaa can be any naturally occurring amino acid except Pro or Gly
  VARIANT (619)..(619): Xaa can be any naturally occurring amino acid except Pro or Gly
  VARIANT (621)..(621): Xaa can be any naturally occurring amino acid
  VARIANT (622)..(622): Xaa can be any naturally occurring amino acid
  VARIANT (623)..(623): Xaa can be any naturally occurring amino acid
  VARIANT (625)..(625): Xaa can be any naturally occurring amino acid except Pro or Gly
  VARIANT (626)..(626): Xaa can be any naturally occurring amino acid except Pro or Gly
  VARIANT (627)..(627): Xaa can be any naturally occurring amino acid except Pro or Gly
  VARIANT (628)..(628): Xaa can be any naturally occurring amino acid except Pro or Gly
  VARIANT (630)..(630): Xaa can be any naturally occurring amino acid
  VARIANT (631)..(631): Xaa can be any naturally occurring amino acid
  VARIANT (632)..(632): Xaa can be any naturally occurring amino acid
  VARIANT (634)..(634): Xaa can be any naturally occurring amino acid except Pro or Gly
  VARIANT (635)..(635): Xaa can be any naturally occurring amino acid except Pro or Gly
  VARIANT (636)..(636): Xaa can be any naturally occurring amino acid except Pro or Gly
  VARIANT (637)..(637): Xaa can be any naturally occurring amino acid except Pro or Gly
  VARIANT (639)..(639): Xaa can be any naturally occurring amino acid
  VARIANT (640)..(640): Xaa can be any naturally occurring amino acid
  VARIANT (641)..(641): Xaa can be any naturally occurring amino acid
  VARIANT (643)..(643): Xaa can be any naturally occurring amino acid except Pro or Gly
  VARIANT (644)..(644): Xaa can be any naturally occurring amino acid except Pro or Gly
  VARIANT (645)..(645): Xaa can be any naturally occurring amino acid except Pro or Gly
  VARIANT (646)..(646): Xaa can be any naturally occurring amino acid except Pro or Gly
  VARIANT (648)..(648): Xaa can be any naturally occurring amino acid
  VARIANT (649)..(649): Xaa can be any naturally occurring amino acid
  VARIANT (650)..(650): Xaa can be any naturally occurring amino acid
  VARIANT (652)..(652): Xaa can be any naturally occurring amino acid except Pro or Gly
  VARIANT (653)..(653): Xaa can be any naturally occurring amino acid except Pro or Gly
  VARIANT (654)..(654): Xaa can be any naturally occurring amino acid except Pro or Gly
  VARIANT (655)..(655): Xaa can be any naturally occurring amino acid except Pro or Gly
  VARIANT (657)..(657): Xaa can be any naturally occurring amino acid
  VARIANT (658)..(658): Xaa can be any naturally occurring amino acid
  VARIANT (659)..(659): Xaa can be any naturally occurring amino acid
  VARIANT (661)..(661): Xaa can be any naturally occurring amino acid except Pro or Gly
  VARIANT (662)..(662): Xaa can be any naturally occurring amino acid except Pro or Gly
  VARIANT (663)..(663): Xaa can be any naturally occurring amino acid except Pro or Gly
  VARIANT (664)..(664): Xaa can be any naturally occurring amino acid except Pro or Gly
  VARIANT (666)..(666): Xaa can be any naturally occurring amino acid
  VARIANT (667)..(667): Xaa can be any naturally occurring amino acid
  VARIANT (668)..(668): Xaa can be any naturally occurring amino acid
  VARIANT (670)..(670): Xaa can be any naturally occurring amino acid except Pro or Gly
  VARIANT (671)..(671): Xaa can be any naturally occurring amino acid except Pro or Gly
  VARIANT (672)..(672): Xaa can be any naturally occurring amino acid except Pro or Gly
  VARIANT (673)..(673): Xaa can be any naturally occurring amino acid except Pro or Gly
  VARIANT (675)..(675): Xaa can be any naturally occurring amino acid
  VARIANT (676)..(676): Xaa can be any naturally occurring amino acid
  VARIANT (677)..(677): Xaa can be any naturally occurring amino acid
  VARIANT (679)..(679): Xaa can be any naturally occurring amino acid except Pro or Gly
  VARIANT (680)..(680): Xaa can be any naturally occurring amino acid except Pro or Gly
  VARIANT (681)..(681): Xaa can be any naturally occurring amino acid except Pro or Gly
  VARIANT (682)..(682): Xaa can be any naturally occurring amino acid except Pro or Gly
  VARIANT (684)..(684): Xaa can be any naturally occurring amino acid
  VARIANT (685)..(685): Xaa can be any naturally occurring amino acid
  VARIANT (686)..(686): Xaa can be any naturally occurring amino acid
  VARIANT (688)..(688): Xaa can be any naturally occurring amino acid except Pro or Gly
  VARIANT (689)..(689): Xaa can be any naturally occurring amino acid except Pro or Gly
  VARIANT (690)..(690): Xaa can be any naturally occurring amino acid except Pro or Gly
  VARIANT (691)..(691): Xaa can be any naturally occurring amino acid except Pro or Gly
  VARIANT (693)..(693): Xaa can be any naturally occurring amino acid
  VARIANT (694)..(694): Xaa can be any naturally occurring amino acid
  VARIANT (695)..(695): Xaa can be any naturally occurring amino acid
  VARIANT (697)..(697): Xaa can be any naturally occurring amino acid except Pro or Gly
  VARIANT (698)..(698): Xaa can be any naturally occurring amino acid except Pro or Gly
  VARIANT (699)..(699): Xaa can be any naturally occurring amino acid except Pro or Gly
  VARIANT (700)..(700): Xaa can be any naturally occurring amino acid except Pro or Gly
  VARIANT (702)..(702): Xaa can be any naturally occurring amino acid
  VARIANT (703)..(703): Xaa can be any naturally occurring amino acid
  VARIANT (704)..(704): Xaa can be any naturally occurring amino acid
  VARIANT (706)..(706): Xaa can be any naturally occurring amino acid except Pro or Gly
  VARIANT (707)..(707): Xaa can be any naturally occurring amino acid except Pro or Gly
  VARIANT (708)..(708): Xaa can be any naturally occurring amino acid except Pro or Gly
  VARIANT (709)..(709): Xaa can be any naturally occurring amino acid except Pro or Gly
  VARIANT (711)..(711): Xaa can be any naturally occurring amino acid
  VARIANT (712)..(712): Xaa can be any naturally occurring amino acid
  VARIANT (713)..(713): Xaa can be any naturally occurring amino acid
  VARIANT (715)..(715): Xaa can be any naturally occurring amino acid except Pro or Gly
  VARIANT (716)..(716): Xaa can be any naturally occurring amino acid except Pro or Gly
  VARIANT (717)..(717): Xaa can be any naturally occurring amino acid except Pro or Gly
  VARIANT (718)..(718): Xaa can be any naturally occurring amino acid except Pro or Gly
  VARIANT (720)..(720): Xaa can be any naturally occurring amino acid
  VARIANT (721)..(721): Xaa can be any naturally occurring amino acid
  VARIANT (722)..(722): Xaa can be any naturally occurring amino acid
  VARIANT (724)..(724): Xaa can be any naturally occurring amino acid except Pro or Gly
  VARIANT (725)..(725): Xaa can be any naturally occurring amino acid except Pro or Gly
  VARIANT (726)..(726): Xaa can be any naturally occurring amino acid except Pro or Gly
  VARIANT (727)..(727): Xaa can be any naturally occurring amino acid except Pro or Gly
  VARIANT (729)..(729): Xaa can be any naturally occurring amino acid
  VARIANT (730)..(730): Xaa can be any naturally occurring amino acid
  VARIANT (731)..(731): Xaa can be any naturally occurring amino acid
  VARIANT (733)..(733): Xaa can be any naturally occurring amino acid except Pro or Gly
  VARIANT (734)..(734): Xaa can be any naturally occurring amino acid except Pro or Gly
  VARIANT (735)..(735): Xaa can be any naturally occurring amino acid except Pro or Gly
  VARIANT (736)..(736): Xaa can be any naturally occurring amino acid except Pro or Gly
  VARIANT (738)..(738): Xaa can be any naturally occurring amino acid
  VARIANT (739)..(739): Xaa can be any naturally occurring amino acid
  VARIANT (740)..(740): Xaa can be any naturally occurring amino acid
  VARIANT (742)..(742): Xaa can be any naturally occurring amino acid except Pro or Gly
  VARIANT (743)..(743): Xaa can be any naturally occurring amino acid except Pro or Gly
  VARIANT (744)..(744): Xaa can be any naturally occurring amino acid except Pro or Gly
  VARIANT (745)..(745): Xaa can be any naturally occurring amino acid except Pro or Gly
  VARIANT (747)..(747): Xaa can be any naturally occurring amino acid
  VARIANT (748)..(748): Xaa can be any naturally occurring amino acid
  VARIANT (749)..(749): Xaa can be any naturally occurring amino acid
  VARIANT (751)..(751): Xaa can be any naturally occurring amino acid except Pro or Gly
  VARIANT (752)..(752): Xaa can be any naturally occurring amino acid except Pro or Gly
  VARIANT (753)..(753): Xaa can be any naturally occurring amino acid except Pro or Gly
  VARIANT (754)..(754): Xaa can be any naturally occurring amino acid except Pro or Gly
  VARIANT (756)..(756): Xaa can be any naturally occurring amino acid
  VARIANT (757)..(757): Xaa can be any naturally occurring amino acid
  VARIANT (758)..(758): Xaa can be any naturally occurring amino acid
  VARIANT (760)..(760): Xaa can be any naturally occurring amino acid except Pro or Gly
  VARIANT (761)..(761): Xaa can be any naturally occurring amino acid except Pro or Gly
  VARIANT (762)..(762): Xaa can be any naturally occurring amino acid except Pro or Gly
  VARIANT (763)..(763): Xaa can be any naturally occurring amino acid except Pro or Gly
  VARIANT (765)..(765): Xaa can be any naturally occurring amino acid
  VARIANT (766)..(766): Xaa can be any naturally occurring amino acid
  VARIANT (767)..(767): Xaa can be any naturally occurring amino acid
  VARIANT (769)..(769): Xaa can be any naturally occurring amino acid except Pro or Gly
  VARIANT (770)..(770): Xaa can be any naturally occurring amino acid except Pro or Gly
  VARIANT (771)..(771): Xaa can be any naturally occurring amino acid except Pro or Gly
  VARIANT (772)..(772): Xaa can be any naturally occurring amino acid except Pro or Gly
  VARIANT (774)..(774): Xaa can be any naturally occurring amino acid
  VARIANT (775)..(775): Xaa can be any naturally occurring amino acid
  VARIANT (776)..(776): Xaa can be any naturally occurring amino acid
  VARIANT (778)..(778): Xaa can be any naturally occurring amino acid except Pro or Gly
  VARIANT (779)..(779): Xaa can be any naturally occurring amino acid except Pro or Gly
  VARIANT (780)..(780): Xaa can be any naturally occurring amino acid except Pro or Gly
  VARIANT (781)..(781): Xaa can be any naturally occurring amino acid except Pro or Gly
  VARIANT (783)..(783): Xaa can be any naturally occurring amino acid
  VARIANT (784)..(784): Xaa can be any naturally occurring amino acid
  VARIANT (785)..(785): Xaa can be any naturally occurring amino acid
  VARIANT (787)..(787): Xaa can be any naturally occurring amino acid except Pro or Gly
  VARIANT (788)..(788): Xaa can be any naturally occurring amino acid except Pro or Gly
  VARIANT (789)..(789): Xaa can be any naturally occurring amino acid except Pro or Gly
  VARIANT (790)..(790): Xaa can be any naturally occurring amino acid except Pro or Gly
  VARIANT (792)..(792): Xaa can be any naturally occurring amino acid
  VARIANT (793)..(793): Xaa can be any naturally occurring amino acid
  VARIANT (794)..(794): Xaa can be any naturally occurring amino acid
  VARIANT (796)..(796): Xaa can be any naturally occurring amino acid except Pro or Gly
  VARIANT (797)..(797): Xaa can be any naturally occurring amino acid except Pro or Gly
  VARIANT (798)..(798): Xaa can be any naturally occurring amino acid except Pro or Gly
  VARIANT (799)..(799): Xaa can be any naturally occurring amino acid except Pro or Gly
  VARIANT (801)..(801): Xaa can be any naturally occurring amino acid
  VARIANT (802)..(802): Xaa can be any naturally occurring amino acid
  VARIANT (803)..(803): Xaa can be any naturally occurring amino acid
  VARIANT (805)..(805): Xaa can be any naturally occurring amino acid except Pro or Gly
  VARIANT (806)..(806): Xaa can be any naturally occurring amino acid except Pro or Gly
  VARIANT (807)..(807): Xaa can be any naturally occurring amino acid except Pro or Gly
  VARIANT (808)..(808): Xaa can be any naturally occurring amino acid except Pro or Gly
  VARIANT (810)..(810): Xaa can be any naturally occurring amino acid
  VARIANT (811)..(811): Xaa can be any naturally occurring amino acid
  VARIANT (812)..(812): Xaa can be any naturally occurring amino acid
  VARIANT (814)..(814): Xaa can be any naturally occurring amino acid except Pro or Gly
  VARIANT (815)..(815): Xaa can be any naturally occurring amino acid except Pro or Gly
  VARIANT (816)..(816): Xaa can be any naturally occurring amino acid except Pro or Gly
  VARIANT (817)..(817): Xaa can be any naturally occurring amino acid except Pro or Gly
  VARIANT (819)..(819): Xaa can be any naturally occurring amino acid
  VARIANT (820)..(820): Xaa can be any naturally occurring amino acid
  VARIANT (821)..(821): Xaa can be any naturally occurring amino acid
  VARIANT (823)..(823): Xaa can be any naturally occurring amino acid except Pro or Gly
  VARIANT (824)..(824): Xaa can be any naturally occurring amino acid except Pro or Gly
  VARIANT (825)..(825): Xaa can be any naturally occurring amino acid except Pro or Gly
  VARIANT (826)..(826): Xaa can be any naturally occurring amino acid except Pro or Gly
  VARIANT (828)..(828): Xaa can be any naturally occurring amino acid
  VARIANT (829)..(829): Xaa can be any naturally occurring amino acid
  VARIANT (830)..(830): Xaa can be any naturally occurring amino acid
  VARIANT (832)..(832): Xaa can be any naturally occurring amino acid except Pro or Gly
  VARIANT (833)..(833): Xaa can be any naturally occurring amino acid except Pro or Gly
  VARIANT (834)..(834): Xaa can be any naturally occurring amino acid except Pro or Gly
  VARIANT (835)..(835): Xaa can be any naturally occurring amino acid except Pro or Gly
  VARIANT (837)..(837): Xaa can be any naturally occurring amino acid
  VARIANT (838)..(838): Xaa can be any naturally occurring amino acid
  VARIANT (839)..(839): Xaa can be any naturally occurring amino acid
  VARIANT (841)..(841): Xaa can be any naturally occurring amino acid except Pro or Gly
  VARIANT (842)..(842): Xaa can be any naturally occurring amino acid except Pro or Gly
  VARIANT (843)..(843): Xaa can be any naturally occurring amino acid except Pro or Gly
  VARIANT (844)..(844): Xaa can be any naturally occurring amino acid except Pro or Gly
  VARIANT (846)..(846): Xaa can be any naturally occurring amino acid
  VARIANT (847)..(847): Xaa can be any naturally occurring amino acid
  VARIANT (848)..(848): Xaa can be any naturally occurring amino acid
  VARIANT (850)..(850): Xaa can be any naturally occurring amino acid except Pro or Gly
  VARIANT (851)..(851): Xaa can be any naturally occurring amino acid except Pro or Gly
  VARIANT (852)..(852): Xaa can be any naturally occurring amino acid except Pro or Gly
  VARIANT (853)..(853): Xaa can be any naturally occurring amino acid except Pro or Gly
  VARIANT (855)..(855): Xaa can be any naturally occurring amino acid
  VARIANT (856)..(856): Xaa can be any naturally occurring amino acid
  VARIANT (857)..(857): Xaa can be any naturally occurring amino acid
  VARIANT (859)..(859): Xaa can be any naturally occurring amino acid except Pro or Gly
  VARIANT (860)..(860): Xaa can be any naturally occurring amino acid except Pro or Gly
  VARIANT (861)..(861): Xaa can be any naturally occurring amino acid except Pro or Gly
  VARIANT (862)..(862): Xaa can be any naturally occurring amino acid except Pro or Gly
  VARIANT (864)..(864): Xaa can be any naturally occurring amino acid
  VARIANT (865)..(865): Xaa can be any naturally occurring amino acid
  VARIANT (866)..(866): Xaa can be any naturally occurring amino acid
  VARIANT (868)..(868): Xaa can be any naturally occurring amino acid except Pro or Gly
  VARIANT (869)..(869): Xaa can be any naturally occurring amino acid except Pro or Gly
  VARIANT (870)..(870): Xaa can be any naturally occurring amino acid except Pro or Gly
  VARIANT (871)..(871): Xaa can be any naturally occurring amino acid except Pro or Gly
  VARIANT (873)..(873): Xaa can be any naturally occurring amino acid
  VARIANT (874)..(874): Xaa can be any naturally occurring amino acid
  VARIANT (875)..(875): Xaa can be any naturally occurring amino acid
  VARIANT (877)..(877): Xaa can be any naturally occurring amino acid except Pro or Gly
  VARIANT (878)..(878): Xaa can be any naturally occurring amino acid except Pro or Gly
  VARIANT (879)..(879): Xaa can be any naturally occurring amino acid except Pro or Gly
  VARIANT (880)..(880): Xaa can be any naturally occurring amino acid except Pro or Gly
  VARIANT (882)..(882): Xaa can be any naturally occurring amino acid
  VARIANT (883)..(883): Xaa can be any naturally occurring amino acid
  VARIANT (884)..(884): Xaa can be any naturally occurring amino acid
  VARIANT (886)..(886): Xaa can be any naturally occurring amino acid except Pro or Gly
  VARIANT (887)..(887): Xaa can be any naturally occurring amino acid except Pro or Gly
  VARIANT (888)..(888): Xaa can be any naturally occurring amino acid except Pro or Gly
  VARIANT (889)..(889): Xaa can be any naturally occurring amino acid except Pro or Gly
  VARIANT (891)..(891): Xaa can be any naturally occurring amino acid
  VARIANT (892)..(892): Xaa can be any naturally occurring amino acid
  VARIANT (893)..(893): Xaa can be any naturally occurring amino acid
  VARIANT (895)..(895): Xaa can be any naturally occurring amino acid except Pro or Gly
  VARIANT (896)..(896): Xaa can be any naturally occurring amino acid except Pro or Gly
  VARIANT (897)..(897): Xaa can be any naturally occurring amino acid except Pro or Gly
  VARIANT (898)..(898): Xaa can be any naturally occurring amino acid except Pro or Gly
  VARIANT (900)..(900): Xaa can be any naturally occurring amino acid
  VARIANT (901)..(901): Xaa can be any naturally occurring amino acid
  VARIANT (902)..(902): Xaa can be any naturally occurring amino acid
  VARIANT (904)..(904): Xaa can be any naturally occurring amino acid except Pro or Gly
  VARIANT (905)..(905): Xaa can be any naturally occurring amino acid except Pro or Gly
  VARIANT (906)..(906): Xaa can be any naturally occurring amino acid except Pro or Gly
  VARIANT (907)..(907): Xaa can be any naturally occurring amino acid except Pro or Gly
  VARIANT (909)..(909): Xaa can be any naturally occurring amino acid
  VARIANT (910)..(910): Xaa can be any naturally occurring amino acid
  VARIANT (911)..(911): Xaa can be any naturally occurring amino acid
  VARIANT (913)..(913): Xaa can be any naturally occurring amino acid except Pro or Gly
  VARIANT (914)..(914): Xaa can be any naturally occurring amino acid except Pro or Gly
  VARIANT (915)..(915): Xaa can be any naturally occurring amino acid except Pro or Gly
  VARIANT (916)..(916): Xaa can be any naturally occurring amino acid except Pro or Gly
  VARIANT (918)..(918): Xaa can be any naturally occurring amino acid
  VARIANT (919)..(919): Xaa can be any naturally occurring amino acid
  VARIANT (920)..(920): Xaa can be any naturally occurring amino acid
  VARIANT (922)..(922): Xaa can be any naturally occurring amino acid except Pro or Gly
  VARIANT (923)..(923): Xaa can be any naturally occurring amino acid except Pro or Gly
  VARIANT (924)..(924): Xaa can be any naturally occurring amino acid except Pro or Gly
  VARIANT (925)..(925): Xaa can be any naturally occurring amino acid except Pro or Gly
  VARIANT (927)..(927): Xaa can be any naturally occurring amino acid
  VARIANT (928)..(928): Xaa can be any naturally occurring amino acid
  VARIANT (929)..(929): Xaa can be any naturally occurring amino acid
  VARIANT (931)..(931): Xaa can be any naturally occurring amino acid except Pro or Gly
  VARIANT (932)..(932): Xaa can be any naturally occurring amino acid except Pro or Gly
  VARIANT (933)..(933): Xaa can be any naturally occurring amino acid except Pro or Gly
  VARIANT (934)..(934): Xaa can be any naturally occurring amino acid except Pro or Gly
  VARIANT (936)..(936): Xaa can be any naturally occurring amino acid
  VARIANT (937)..(937): Xaa can be any naturally occurring amino acid
  VARIANT (938)..(938): Xaa can be any naturally occurring amino acid
  VARIANT (940)..(940): Xaa can be any naturally occurring amino acid except Pro or Gly
  VARIANT (941)..(941): Xaa can be any naturally occurring amino acid except Pro or Gly
  VARIANT (942)..(942): Xaa can be any naturally occurring amino acid except Pro or Gly
  VARIANT (943)..(943): Xaa can be any naturally occurring amino acid except Pro or Gly
  VARIANT (945)..(945): Xaa can be any naturally occurring amino acid
  VARIANT (946)..(946): Xaa can be any naturally occurring amino acid
  VARIANT (947)..(947): Xaa can be any naturally occurring amino acid
  VARIANT (949)..(949): Xaa can be any naturally occurring amino acid except Pro or Gly
  VARIANT (950)..(950): Xaa can be any naturally occurring amino acid except Pro or Gly
  VARIANT (951)..(951): Xaa can be any naturally occurring amino acid except Pro or Gly
  VARIANT (952)..(952): Xaa can be any naturally occurring amino acid except Pro or Gly
  VARIANT (954)..(954): Xaa can be any naturally occurring amino acid
  VARIANT (955)..(955): Xaa can be any naturally occurring amino acid
  VARIANT (956)..(956): Xaa can be any naturally occurring amino acid
  VARIANT (958)..(958): Xaa can be any naturally occurring amino acid except Pro or Gly
  VARIANT (959)..(959): Xaa can be any naturally occurring amino acid except Pro or Gly
  VARIANT (960)..(960): Xaa can be any naturally occurring amino acid except Pro or Gly
  VARIANT (961)..(961): Xaa can be any naturally occurring amino acid except Pro or Gly
  VARIANT (963)..(963): Xaa can be any naturally occurring amino acid
  VARIANT (964)..(964): Xaa can be any naturally occurring amino acid
  VARIANT (965)..(965): Xaa can be any naturally occurring amino acid
  VARIANT (967)..(967): Xaa can be any naturally occurring amino acid except Pro or Gly
  VARIANT (968)..(968): Xaa can be any naturally occurring amino acid except Pro or Gly
  VARIANT (969)..(969): Xaa can be any naturally occurring amino acid except Pro or Gly
  VARIANT (970)..(970): Xaa can be any naturally occurring amino acid except Pro or Gly
  VARIANT (972)..(972): Xaa can be any naturally occurring amino acid
  VARIANT (973)..(973): Xaa can be any naturally occurring amino acid
  VARIANT (974)..(974): Xaa can be any naturally occurring amino acid
  VARIANT (976)..(976): Xaa can be any naturally occurring amino acid except Pro or Gly
  VARIANT (977)..(977): Xaa can be any naturally occurring amino acid except Pro or Gly
  VARIANT (978)..(978): Xaa can be any naturally occurring amino acid except Pro or Gly
  VARIANT (979)..(979): Xaa can be any naturally occurring amino acid except Pro or Gly
  VARIANT (981)..(981): Xaa can be any naturally occurring amino acid
  VARIANT (982)..(982): Xaa can be any naturally occurring amino acid
  VARIANT (983)..(983): Xaa can be any naturally occurring amino acid
  VARIANT (985)..(985): Xaa can be any naturally occurring amino acid except Pro or Gly
  VARIANT (986)..(986): Xaa can be any naturally occurring amino acid except Pro or Gly
  VARIANT (987)..(987): Xaa can be any naturally occurring amino acid except Pro or Gly
  VARIANT (988)..(988): Xaa can be any naturally occurring amino acid except Pro or Gly
  VARIANT (990)..(990): Xaa can be any naturally occurring amino acid
  VARIANT (991)..(991): Xaa can be any naturally occurring amino acid
  VARIANT (992)..(992): Xaa can be any naturally occurring amino acid
  VARIANT (994)..(994): Xaa can be any naturally occurring amino acid except Pro or Gly
  VARIANT (995)..(995): Xaa can be any naturally occurring amino acid except Pro or Gly
  VARIANT (996)..(996): Xaa can be any naturally occurring amino acid except Pro or Gly
  VARIANT (997)..(997): Xaa can be any naturally occurring amino acid except Pro or Gly
  VARIANT (999)..(999): Xaa can be any naturally occurring amino acid
  VARIANT (1000)..(1000): Xaa can be any naturally occurring amino acid
  VARIANT (1001)..(1001): Xaa can be any naturally occurring amino acid
  VARIANT (1003)..(1003): Xaa can be any naturally occurring amino acid except Pro or Gly
  VARIANT (1004)..(1004): Xaa can be any naturally occurring amino acid except Pro or Gly
  VARIANT (1005)..(1005): Xaa can be any naturally occurring amino acid except Pro or Gly
  VARIANT (1006)..(1006): Xaa can be any naturally occurring amino acid except Pro or Gly
  VARIANT (1008)..(1008): Xaa can be any naturally occurring amino acid
  VARIANT (1009)..(1009): Xaa can be any naturally occurring amino acid
  VARIANT (1010)..(1010): Xaa can be any naturally occurring amino acid
  VARIANT (1012)..(1012): Xaa can be any naturally occurring amino acid except Pro or Gly
  VARIANT (1013)..(1013): Xaa can be any naturally occurring amino acid except Pro or Gly
  VARIANT (1014)..(1014): Xaa can be any naturally occurring amino acid except Pro or Gly
  VARIANT (1015)..(1015): Xaa can be any naturally occurring amino acid except Pro or Gly
  VARIANT (1017)..(1017): Xaa can be any naturally occurring amino acid
  VARIANT (1018)..(1018): Xaa can be any naturally occurring amino acid
  VARIANT (1019)..(1019): Xaa can be any naturally occurring amino acid
  VARIANT (1021)..(1021): Xaa can be any naturally occurring amino acid except Pro or Gly
  VARIANT (1022)..(1022): Xaa can be any naturally occurring amino acid except Pro or Gly
  VARIANT (1023)..(1023): Xaa can be any naturally occurring amino acid except Pro or Gly
  VARIANT (1024)..(1024): Xaa can be any naturally occurring amino acid except Pro or Gly
  VARIANT (1026)..(1026): Xaa can be any naturally occurring amino acid
  VARIANT (1027)..(1027): Xaa can be any naturally occurring amino acid
  VARIANT (1028)..(1028): Xaa can be any naturally occurring amino acid
  VARIANT (1030)..(1030): Xaa can be any naturally occurring amino acid except Pro or Gly
  VARIANT (1031)..(1031): Xaa can be any naturally occurring amino acid except Pro or Gly
  VARIANT (1032)..(1032): Xaa can be any naturally occurring amino acid except Pro or Gly
  VARIANT (1033)..(1033): Xaa can be any naturally occurring amino acid except Pro or Gly
  VARIANT (1035)..(1035): Xaa can be any naturally occurring amino acid
  VARIANT (1036)..(1036): Xaa can be any naturally occurring amino acid
  VARIANT (1037)..(1037): Xaa can be any naturally occurring amino acid
  VARIANT (1039)..(1039): Xaa can be any naturally occurring amino acid except Pro or Gly
  VARIANT (1040)..(1040): Xaa can be any naturally occurring amino acid except Pro or Gly
  VARIANT (1041)..(1041): Xaa can be any naturally occurring amino acid except Pro or Gly
  VARIANT (1042)..(1042): Xaa can be any naturally occurring amino acid except Pro or Gly
  VARIANT (1044)..(1044): Xaa can be any naturally occurring amino acid
  VARIANT (1045)..(1045): Xaa can be any naturally occurring amino acid
  VARIANT (1046)..(1046): Xaa can be any naturally occurring amino acid
  VARIANT (1048)..(1048): Xaa can be any naturally occurring amino acid except Pro or Gly
  VARIANT (1049)..(1049): Xaa can be any naturally occurring amino acid except Pro or Gly
  VARIANT (1050)..(1050): Xaa can be any naturally occurring amino acid except Pro or Gly
  VARIANT (1051)..(1051): Xaa can be any naturally occurring amino acid except Pro or Gly
  VARIANT (1053)..(1053): Xaa can be any naturally occurring amino acid
  VARIANT (1054)..(1054): Xaa can be any naturally occurring amino acid
  VARIANT (1055)..(1055): Xaa can be any naturally occurring amino acid
  VARIANT (1057)..(1057): Xaa can be any naturally occurring amino acid except Pro or Gly
  VARIANT (1058)..(1058): Xaa can be any naturally occurring amino acid except Pro or Gly
  VARIANT (1059)..(1059): Xaa can be any naturally occurring amino acid except Pro or Gly
  VARIANT (1060)..(1060): Xaa can be any naturally occurring amino acid except Pro or Gly
  VARIANT (1062)..(1062): Xaa can be any naturally occurring amino acid
  VARIANT (1063)..(1063): Xaa can be any naturally occurring amino acid
  VARIANT (1064)..(1064): Xaa can be any naturally occurring amino acid
  VARIANT (1066)..(1066): Xaa can be any naturally occurring amino acid except Pro or Gly
  VARIANT (1067)..(1067): Xaa can be any naturally occurring amino acid except Pro or Gly
  VARIANT (1068)..(1068): Xaa can be any naturally occurring amino acid except Pro or Gly
  VARIANT (1069)..(1069): Xaa can be any naturally occurring amino acid except Pro or Gly
  VARIANT (1071)..(1071): Xaa can be any naturally occurring amino acid
  VARIANT (1072)..(1072): Xaa can be any naturally occurring amino acid
  VARIANT (1073)..(1073): Xaa can be any naturally occurring amino acid
  VARIANT (1075)..(1075): Xaa can be any naturally occurring amino acid except Pro or Gly
  VARIANT (1076)..(1076): Xaa can be any naturally occurring amino acid except Pro or Gly
  VARIANT (1077)..(1077): Xaa can be any naturally occurring amino acid except Pro or Gly
  VARIANT (1078)..(1078): Xaa can be any naturally occurring amino acid except Pro or Gly
  VARIANT (1080)..(1080): Xaa can be any naturally occurring amino acid
  VARIANT (1081)..(1081): Xaa can be any naturally occurring amino acid
  VARIANT (1082)..(1082): Xaa can be any naturally occurring amino acid
  VARIANT (1084)..(1084): Xaa can be any naturally occurring amino acid except Pro or Gly
  VARIANT (1085)..(1085): Xaa can be any naturally occurring amino acid except Pro or Gly
  VARIANT (1086)..(1086): Xaa can be any naturally occurring amino acid except Pro or Gly
  VARIANT (1087)..(1087): Xaa can be any naturally occurring amino acid except Pro or Gly
  VARIANT (1089)..(1089): Xaa can be any naturally occurring amino acid
  VARIANT (1090)..(1090): Xaa can be any naturally occurring amino acid
  VARIANT (1091)..(1091): Xaa can be any naturally occurring amino acid
  VARIANT (1093)..(1093): Xaa can be any naturally occurring amino acid except Pro or Gly
  VARIANT (1094)..(1094): Xaa can be any naturally occurring amino acid except Pro or Gly
  VARIANT (1095)..(1095): Xaa can be any naturally occurring amino acid except Pro or Gly
  VARIANT (1096)..(1096): Xaa can be any naturally occurring amino acid except Pro or Gly
  VARIANT (1098)..(1098): Xaa can be any naturally occurring amino acid
  VARIANT (1099)..(1099): Xaa can be any naturally occurring amino acid
  VARIANT (1100)..(1100): Xaa can be any naturally occurring amino acid
  VARIANT (1102)..(1102): Xaa can be any naturally occurring amino acid except Pro or Gly
  VARIANT (1103)..(1103): Xaa can be any naturally occurring amino acid except Pro or Gly
  VARIANT (1104)..(1104): Xaa can be any naturally occurring amino acid except Pro or Gly
  VARIANT (1105)..(1105): Xaa can be any naturally occurring amino acid except Pro or Gly
  VARIANT (1107)..(1107): Xaa can be any naturally occurring amino acid
  VARIANT (1108)..(1108): Xaa can be any naturally occurring amino acid
  VARIANT (1109)..(1109): Xaa can be any naturally occurring amino acid
  VARIANT (1111)..(1111): Xaa can be any naturally occurring amino acid except Pro or Gly
  VARIANT (1112)..(1112): Xaa can be any naturally occurring amino acid except Pro or Gly
  VARIANT (1113)..(1113): Xaa can be any naturally occurring amino acid except Pro or Gly
  VARIANT (1114)..(1114): Xaa can be any naturally occurring amino acid except Pro or Gly
  VARIANT (1116)..(1116): Xaa can be any naturally occurring amino acid
  VARIANT (1117)..(1117): Xaa can be any naturally occurring amino acid
  VARIANT (1118)..(1118): Xaa can be any naturally occurring amino acid
  VARIANT (1120)..(1120): Xaa can be any naturally occurring amino acid except Pro or Gly
  VARIANT (1121)..(1121): Xaa can be any naturally occurring amino acid except Pro or Gly
  VARIANT (1122)..(1122): Xaa can be any naturally occurring amino acid except Pro or Gly
  VARIANT (1123)..(1123): Xaa can be any naturally occurring amino acid except Pro or Gly
  VARIANT (1125)..(1125): Xaa can be any naturally occurring amino acid
  VARIANT (1126)..(1126): Xaa can be any naturally occurring amino acid
  VARIANT (1127)..(1127): Xaa can be any naturally occurring amino acid
  VARIANT (1129)..(1129): Xaa can be any naturally occurring amino acid except Pro or Gly
  VARIANT (1130)..(1130): Xaa can be any naturally occurring amino acid except Pro or Gly
  VARIANT (1131)..(1131): Xaa can be any naturally occurring amino acid except Pro or Gly
  VARIANT (1132)..(1132): Xaa can be any naturally occurring amino acid except Pro or Gly
  VARIANT (1134)..(1134): Xaa can be any naturally occurring amino acid
  VARIANT (1135)..(1135): Xaa can be any naturally occurring amino acid
  VARIANT (1136)..(1136): Xaa can be any naturally occurring amino acid
  VARIANT (1138)..(1138): Xaa can be any naturally occurring amino acid except Pro or Gly
  VARIANT (1139)..(1139): Xaa can be any naturally occurring amino acid except Pro or Gly
  VARIANT (1140)..(1140): Xaa can be any naturally occurring amino acid except Pro or Gly
  VARIANT (1141)..(1141): Xaa can be any naturally occurring amino acid except Pro or Gly
  VARIANT (1143)..(1143): Xaa can be any naturally occurring amino acid
  VARIANT (1144)..(1144): Xaa can be any naturally occurring amino acid
  VARIANT (1145)..(1145): Xaa can be any naturally occurring amino acid
  VARIANT (1147)..(1147): Xaa can be any naturally occurring amino acid except Pro or Gly
  VARIANT (1148)..(1148): Xaa can be any naturally occurring amino acid except Pro or Gly
  VARIANT (1149)..(1149): Xaa can be any naturally occurring amino acid except Pro or Gly
  VARIANT (1150)..(1150): Xaa can be any naturally occurring amino acid except Pro or Gly
  VARIANT (1152)..(1152): Xaa can be any naturally occurring amino acid
  VARIANT (1153)..(1153): Xaa can be any naturally occurring amino acid
  VARIANT (1154)..(1154): Xaa can be any naturally occurring amino acid
  VARIANT (1156)..(1156): Xaa can be any naturally occurring amino acid except Pro or Gly
  VARIANT (1157)..(1157): Xaa can be any naturally occurring amino acid except Pro or Gly
  VARIANT (1158)..(1158): Xaa can be any naturally occurring amino acid except Pro or Gly
  VARIANT (1159)..(1159): Xaa can be any naturally occurring amino acid except Pro or Gly
  VARIANT (1161)..(1161): Xaa can be any naturally occurring amino acid
  VARIANT (1162)..(1162): Xaa can be any naturally occurring amino acid
  VARIANT (1163)..(1163): Xaa can be any naturally occurring amino acid
  VARIANT (1165)..(1165): Xaa can be any naturally occurring amino acid except Pro or Gly
  VARIANT (1166)..(1166): Xaa can be any naturally occurring amino acid except Pro or Gly
  VARIANT (1167)..(1167): Xaa can be any naturally occurring amino acid except Pro or Gly
  VARIANT (1168)..(1168): Xaa can be any naturally occurring amino acid except Pro or Gly
  VARIANT (1170)..(1170): Xaa can be any naturally occurring amino acid
  VARIANT (1171)..(1171): Xaa can be any naturally occurring amino acid
  VARIANT (1172)..(1172): Xaa can be any naturally occurring amino acid
  VARIANT (1174)..(1174): Xaa can be any naturally occurring amino acid except Pro or Gly
  VARIANT (1175)..(1175): Xaa can be any naturally occurring amino acid except Pro or Gly
  VARIANT (1176)..(1176): Xaa can be any naturally occurring amino acid except Pro or Gly
  VARIANT (1177)..(1177): Xaa can be any naturally occurring amino acid except Pro or Gly
  VARIANT (1179)..(1179): Xaa can be any naturally occurring amino acid
  VARIANT (1180)..(1180): Xaa can be any naturally occurring amino acid
  VARIANT (1181)..(1181): Xaa can be any naturally occurring amino acid
  VARIANT (1183)..(1183): Xaa can be any naturally occurring amino acid except Pro or Gly
  VARIANT (1184)..(1184): Xaa can be any naturally occurring amino acid except Pro or Gly
  VARIANT (1185)..(1185): Xaa can be any naturally occurring amino acid except Pro or Gly
  VARIANT (1186)..(1186): Xaa can be any naturally occurring amino acid except Pro or Gly
  VARIANT (1188)..(1188): Xaa can be any naturally occurring amino acid
  VARIANT (1189)..(1189): Xaa can be any naturally occurring amino acid
  VARIANT (1190)..(1190): Xaa can be any naturally occurring amino acid
  VARIANT (1192)..(1192): Xaa can be any naturally occurring amino acid except Pro or Gly
  VARIANT (1193)..(1193): Xaa can be any naturally occurring amino acid except Pro or Gly
  VARIANT (1194)..(1194): Xaa can be any naturally occurring amino acid except Pro or Gly
  VARIANT (1195)..(1195): Xaa can be any naturally occurring amino acid except Pro or Gly
  VARIANT (1197)..(1197): Xaa can be any naturally occurring amino acid
  VARIANT (1198)..(1198): Xaa can be any naturally occurring amino acid
  VARIANT (1199)..(1199): Xaa can be any naturally occurring amino acid
  VARIANT (1201)..(1201): Xaa can be any naturally occurring amino acid except Pro or Gly
  VARIANT (1202)..(1202): Xaa can be any naturally occurring amino acid except Pro or Gly
  VARIANT (1203)..(1203): Xaa can be any naturally occurring amino acid except Pro or Gly
  VARIANT (1204)..(1204): Xaa can be any naturally occurring amino acid except Pro or Gly
  VARIANT (1206)..(1206): Xaa can be any naturally occurring amino acid
  VARIANT (1207)..(1207): Xaa can be any naturally occurring amino acid
  VARIANT (1208)..(1208): Xaa can be any naturally occurring amino acid
  VARIANT (1210)..(1210): Xaa can be any naturally occurring amino acid except Pro or Gly
  VARIANT (1211)..(1211): Xaa can be any naturally occurring amino acid except Pro or Gly
  VARIANT (1212)..(1212): Xaa can be any naturally occurring amino acid except Pro or Gly
  VARIANT (1213)..(1213): Xaa can be any naturally occurring amino acid except Pro or Gly
  VARIANT (1215)..(1215): Xaa can be any naturally occurring amino acid
  VARIANT (1216)..(1216): Xaa can be any naturally occurring amino acid
  VARIANT (1217)..(1217): Xaa can be any naturally occurring amino acid
  VARIANT (1219)..(1219): Xaa can be any naturally occurring amino acid except Pro or Gly
  VARIANT (1220)..(1220): Xaa can be any naturally occurring amino acid except Pro or Gly
  VARIANT (1221)..(1221): Xaa can be any naturally occurring amino acid except Pro or Gly
  VARIANT (1222)..(1222): Xaa can be any naturally occurring amino acid except Pro or Gly
  VARIANT (1224)..(1224): Xaa can be any naturally occurring amino acid
  VARIANT (1225)..(1225): Xaa can be any naturally occurring amino acid
  VARIANT (1226)..(1226): Xaa can be any naturally occurring amino acid
  VARIANT (1228)..(1228): Xaa can be any naturally occurring amino acid except Pro or Gly
  VARIANT (1229)..(1229): Xaa can be any naturally occurring amino acid except Pro or Gly
  VARIANT (1230)..(1230): Xaa can be any naturally occurring amino acid except Pro or Gly
  VARIANT (1231)..(1231): Xaa can be any naturally occurring amino acid except Pro or Gly
  VARIANT (1233)..(1233): Xaa can be any naturally occurring amino acid
  VARIANT (1234)..(1234): Xaa can be any naturally occurring amino acid
  VARIANT (1235)..(1235): Xaa can be any naturally occurring amino acid
  VARIANT (1237)..(1237): Xaa can be any naturally occurring amino acid except Pro or Gly
  VARIANT (1238)..(1238): Xaa can be any naturally occurring amino acid except Pro or Gly
  VARIANT (1239)..(1239): Xaa can be any naturally occurring amino acid except Pro or Gly
  VARIANT (1240)..(1240): Xaa can be any naturally occurring amino acid except Pro or Gly
  VARIANT (1242)..(1242): Xaa can be any naturally occurring amino acid
  VARIANT (1243)..(1243): Xaa can be any naturally occurring amino acid
  VARIANT (1244)..(1244): Xaa can be any naturally occurring amino acid
  VARIANT (1246)..(1246): Xaa can be any naturally occurring amino acid except Pro or Gly
  VARIANT (1247)..(1247): Xaa can be any naturally occurring amino acid except Pro or Gly
  VARIANT (1248)..(1248): Xaa can be any naturally occurring amino acid except Pro or Gly
  VARIANT (1249)..(1249): Xaa can be any naturally occurring amino acid except Pro or Gly
  VARIANT (1251)..(1251): Xaa can be any naturally occurring amino acid
  VARIANT (1252)..(1252): Xaa can be any naturally occurring amino acid
  VARIANT (1253)..(1253): Xaa can be any naturally occurring amino acid
  VARIANT (1255)..(1255): Xaa can be any naturally occurring amino acid except Pro or Gly
  VARIANT (1256)..(1256): Xaa can be any naturally occurring amino acid except Pro or Gly
  VARIANT (1257)..(1257): Xaa can be any naturally occurring amino acid except Pro or Gly
  VARIANT (1258)..(1258): Xaa can be any naturally occurring amino acid except Pro or Gly
  VARIANT (1260)..(1260): Xaa can be any naturally occurring amino acid
  VARIANT (1261)..(1261): Xaa can be any naturally occurring amino acid
  VARIANT (1262)..(1262): Xaa can be any naturally occurring amino acid
  VARIANT (1264)..(1264): Xaa can be any naturally occurring amino acid except Pro or Gly
  VARIANT (1265)..(1265): Xaa can be any naturally occurring amino acid except Pro or Gly
  VARIANT (1266)..(1266): Xaa can be any naturally occurring amino acid except Pro or Gly
  VARIANT (1267)..(1267): Xaa can be any naturally occurring amino acid except Pro or Gly
  VARIANT (1269)..(1269): Xaa can be any naturally occurring amino acid
  VARIANT (1270)..(1270): Xaa can be any naturally occurring amino acid
  VARIANT (1271)..(1271): Xaa can be any naturally occurring amino acid
  VARIANT (1273)..(1273): Xaa can be any naturally occurring amino acid except Pro or Gly
  VARIANT (1274)..(1274): Xaa can be any naturally occurring amino acid except Pro or Gly
  VARIANT (1275)..(1275): Xaa can be any naturally occurring amino acid except Pro or Gly
  VARIANT (1276)..(1276): Xaa can be any naturally occurring amino acid except Pro or Gly
  VARIANT (1278)..(1278): Xaa can be any naturally occurring amino acid
  VARIANT (1279)..(1279): Xaa can be any naturally occurring amino acid
  VARIANT (1280)..(1280): Xaa can be any naturally occurring amino acid
  VARIANT (1282)..(1282): Xaa can be any naturally occurring amino acid except Pro or Gly
  VARIANT (1283)..(1283): Xaa can be any naturally occurring amino acid except Pro or Gly
  VARIANT (1284)..(1284): Xaa can be any naturally occurring amino acid except Pro or Gly
  VARIANT (1285)..(1285): Xaa can be any naturally occurring amino acid except Pro or Gly
  VARIANT (1287)..(1287): Xaa can be any naturally occurring amino acid
  VARIANT (1288)..(1288): Xaa can be any naturally occurring amino acid
  VARIANT (1289)..(1289): Xaa can be any naturally occurring amino acid
  VARIANT (1291)..(1291): Xaa can be any naturally occurring amino acid except Pro or Gly
  VARIANT (1292)..(1292): Xaa can be any naturally occurring amino acid except Pro or Gly
  VARIANT (1293)..(1293): Xaa can be any naturally occurring amino acid except Pro or Gly
  VARIANT (1294)..(1294): Xaa can be any naturally occurring amino acid except Pro or Gly
  VARIANT (1296)..(1296): Xaa can be any naturally occurring amino acid
  VARIANT (1297)..(1297): Xaa can be any naturally occurring amino acid
  VARIANT (1298)..(1298): Xaa can be any naturally occurring amino acid
  VARIANT (1300)..(1300): Xaa can be any naturally occurring amino acid except Pro or Gly
  VARIANT (1301)..(1301): Xaa can be any naturally occurring amino acid except Pro or Gly
  VARIANT (1302)..(1302): Xaa can be any naturally occurring amino acid except Pro or Gly
  VARIANT (1303)..(1303): Xaa can be any naturally occurring amino acid except Pro or Gly
  VARIANT (1305)..(1305): Xaa can be any naturally occurring amino acid
  VARIANT (1306)..(1306): Xaa can be any naturally occurring amino acid
  VARIANT (1307)..(1307): Xaa can be any naturally occurring amino acid
  VARIANT (1309)..(1309): Xaa can be any naturally occurring amino acid except Pro or Gly
  VARIANT (1310)..(1310): Xaa can be any naturally occurring amino acid except Pro or Gly
  VARIANT (1311)..(1311): Xaa can be any naturally occurring amino acid except Pro or Gly
  VARIANT (1312)..(1312): Xaa can be any naturally occurring amino acid except Pro or Gly
  VARIANT (1314)..(1314): Xaa can be any naturally occurring amino acid
  VARIANT (1315)..(1315): Xaa can be any naturally occurring amino acid
  VARIANT (1316)..(1316): Xaa can be any naturally occurring amino acid
  VARIANT (1318)..(1318): Xaa can be any naturally occurring amino acid except Pro or Gly
  VARIANT (1319)..(1319): Xaa can be any naturally occurring amino acid except Pro or Gly
  VARIANT (1320)..(1320): Xaa can be any naturally occurring amino acid except Pro or Gly
  VARIANT (1321)..(1321): Xaa can be any naturally occurring amino acid except Pro or Gly
  VARIANT (1323)..(1323): Xaa can be any naturally occurring amino acid
  VARIANT (1324)..(1324): Xaa can be any naturally occurring amino acid
  VARIANT (1325)..(1325): Xaa can be any naturally occurring amino acid
  VARIANT (1327)..(1327): Xaa can be any naturally occurring amino acid except Pro or Gly
  VARIANT (1328)..(1328): Xaa can be any naturally occurring amino acid except Pro or Gly
  VARIANT (1329)..(1329): Xaa can be any naturally occurring amino acid except Pro or Gly
  VARIANT (1330)..(1330): Xaa can be any naturally occurring amino acid except Pro or Gly
  VARIANT (1332)..(1332): Xaa can be any naturally occurring amino acid
  VARIANT (1333)..(1333): Xaa can be any naturally occurring amino acid
  VARIANT (1334)..(1334): Xaa can be any naturally occurring amino acid
  VARIANT (1336)..(1336): Xaa can be any naturally occurring amino acid except Pro or Gly
  VARIANT (1337)..(1337): Xaa can be any naturally occurring amino acid except Pro or Gly
  VARIANT (1338)..(1338): Xaa can be any naturally occurring amino acid except Pro or Gly
  VARIANT (1339)..(1339): Xaa can be any naturally occurring amino acid except Pro or Gly
  VARIANT (1341)..(1341): Xaa can be any naturally occurring amino acid
  VARIANT (1342)..(1342): Xaa can be any naturally occurring amino acid
  VARIANT (1343)..(1343): Xaa can be any naturally occurring amino acid
  VARIANT (1345)..(1345): Xaa can be any naturally occurring amino acid except Pro or Gly
  VARIANT (1346)..(1346): Xaa can be any naturally occurring amino acid except Pro or Gly
  VARIANT (1347)..(1347): Xaa can be any naturally occurring amino acid except Pro or Gly
  VARIANT (1348)..(1348): Xaa can be any naturally occurring amino acid except Pro or Gly
  VARIANT (1350)..(1350): Xaa can be any naturally occurring amino acid
  VARIANT (1351)..(1351): Xaa can be any naturally occurring amino acid
  VARIANT (1352)..(1352): Xaa can be any naturally occurring amino acid
  VARIANT (1354)..(1354): Xaa can be any naturally occurring amino acid except Pro or Gly
  VARIANT (1355)..(1355): Xaa can be any naturally occurring amino acid except Pro or Gly
  VARIANT (1356)..(1356): Xaa can be any naturally occurring amino acid except Pro or Gly
  VARIANT (1357)..(1357): Xaa can be any naturally occurring amino acid except Pro or Gly
  VARIANT (1359)..(1359): Xaa can be any naturally occurring amino acid
  VARIANT (1360)..(1360): Xaa can be any naturally occurring amino acid
  VARIANT (1361)..(1361): Xaa can be any naturally occurring amino acid
  VARIANT (1363)..(1363): Xaa can be any naturally occurring amino acid except Pro or Gly
  VARIANT (1364)..(1364): Xaa can be any naturally occurring amino acid except Pro or Gly
  VARIANT (1365)..(1365): Xaa can be any naturally occurring amino acid except Pro or Gly
  VARIANT (1366)..(1366): Xaa can be any naturally occurring amino acid except Pro or Gly
  VARIANT (1368)..(1368): Xaa can be any naturally occurring amino acid
  VARIANT (1369)..(1369): Xaa can be any naturally occurring amino acid
  VARIANT (1370)..(1370): Xaa can be any naturally occurring amino acid
  VARIANT (1372)..(1372): Xaa can be any naturally occurring amino acid except Pro or Gly
  VARIANT (1373)..(1373): Xaa can be any naturally occurring amino acid except Pro or Gly
  VARIANT (1374)..(1374): Xaa can be any naturally occurring amino acid except Pro or Gly
  VARIANT (1375)..(1375): Xaa can be any naturally occurring amino acid except Pro or Gly
  VARIANT (1377)..(1377): Xaa can be any naturally occurring amino acid
  VARIANT (1378)..(1378): Xaa can be any naturally occurring amino acid
  VARIANT (1379)..(1379): Xaa can be any naturally occurring amino acid
  VARIANT (1381)..(1381): Xaa can be any naturally occurring amino acid except Pro or Gly
  VARIANT (1382)..(1382): Xaa can be any naturally occurring amino acid except Pro or Gly
  VARIANT (1383)..(1383): Xaa can be any naturally occurring amino acid except Pro or Gly
  VARIANT (1384)..(1384): Xaa can be any naturally occurring amino acid except Pro or Gly
  VARIANT (1386)..(1386): Xaa can be any naturally occurring amino acid
  VARIANT (1387)..(1387): Xaa can be any naturally occurring amino acid
  VARIANT (1388)..(1388): Xaa can be any naturally occurring amino acid
  VARIANT (1390)..(1390): Xaa can be any naturally occurring amino acid except Pro or Gly
  VARIANT (1391)..(1391): Xaa can be any naturally occurring amino acid except Pro or Gly
  VARIANT (1392)..(1392): Xaa can be any naturally occurring amino acid except Pro or Gly
  VARIANT (1393)..(1393): Xaa can be any naturally occurring amino acid except Pro or Gly
  VARIANT (1395)..(1395): Xaa can be any naturally occurring amino acid
  VARIANT (1396)..(1396): Xaa can be any naturally occurring amino acid
  VARIANT (1397)..(1397): Xaa can be any naturally occurring amino acid
  VARIANT (1399)..(1399): Xaa can be any naturally occurring amino acid except Pro or Gly
  VARIANT (1400)..(1400): Xaa can be any naturally occurring amino acid except Pro or Gly
  VARIANT (1401)..(1401): Xaa can be any naturally occurring amino acid except Pro or Gly
  VARIANT (1402)..(1402): Xaa can be any naturally occurring amino acid except Pro or Gly
  VARIANT (1404)..(1404): Xaa can be any naturally occurring amino acid
  VARIANT (1405)..(1405): Xaa can be any naturally occurring amino acid
  VARIANT (1406)..(1406): Xaa can be any naturally occurring amino acid
  VARIANT (1408)..(1408): Xaa can be any naturally occurring amino acid except Pro or Gly
  VARIANT (1409)..(1409): Xaa can be any naturally occurring amino acid except Pro or Gly
  VARIANT (1410)..(1410): Xaa can be any naturally occurring amino acid except Pro or Gly
  VARIANT (1411)..(1411): Xaa can be any naturally occurring amino acid except Pro or Gly
  VARIANT (1413)..(1413): Xaa can be any naturally occurring amino acid
  VARIANT (1414)..(1414): Xaa can be any naturally occurring amino acid
  VARIANT (1415)..(1415): Xaa can be any naturally occurring amino acid
  VARIANT (1417)..(1417): Xaa can be any naturally occurring amino acid except Pro or Gly
  VARIANT (1418)..(1418): Xaa can be any naturally occurring amino acid except Pro or Gly
  VARIANT (1419)..(1419): Xaa can be any naturally occurring amino acid except Pro or Gly
  VARIANT (1420)..(1420): Xaa can be any naturally occurring amino acid except Pro or Gly
  VARIANT (1422)..(1422): Xaa can be any naturally occurring amino acid
  VARIANT (1423)..(1423): Xaa can be any naturally occurring amino acid
  VARIANT (1424)..(1424): Xaa can be any naturally occurring amino acid
  VARIANT (1426)..(1426): Xaa can be any naturally occurring amino acid except Pro or Gly
  VARIANT (1427)..(1427): Xaa can be any naturally occurring amino acid except Pro or Gly
  VARIANT (1428)..(1428): Xaa can be any naturally occurring amino acid except Pro or Gly
  VARIANT (1429)..(1429): Xaa can be any naturally occurring amino acid except Pro or Gly
  VARIANT (1431)..(1431): Xaa can be any naturally occurring amino acid
  VARIANT (1432)..(1432): Xaa can be any naturally occurring amino acid
  VARIANT (1433)..(1433): Xaa can be any naturally occurring amino acid
  VARIANT (1435)..(1435): Xaa can be any naturally occurring amino acid except Pro or Gly
  VARIANT (1436)..(1436): Xaa can be any naturally occurring amino acid except Pro or Gly
  VARIANT (1437)..(1437): Xaa can be any naturally occurring amino acid except Pro or Gly
  VARIANT (1438)..(1438): Xaa can be any naturally occurring amino acid except Pro or Gly
  VARIANT (1440)..(1440): Xaa can be any naturally occurring amino acid
XXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGX

SEQ ID NO: 149 - protein, 960 aa, Artificial Sequence
  elastin-like polypeptide
  VARIANT (1)..(1): Xaa can be any naturally occurring amino acid
  VARIANT (2)..(2): Xaa can be any naturally occurring amino acid
  VARIANT (4)..(4): Xaa can be any naturally occurring amino acid except Pro or Gly
  VARIANT (6)..(6): Xaa can be any naturally occurring amino acid
  VARIANT (7)..(7): Xaa can be any naturally occurring amino acid
  VARIANT (8)..(8): Xaa can be any naturally occurring amino acid
  VARIANT (10)..(10): Xaa can be any naturally occurring amino acid except Pro or Gly
  VARIANT (12)..(12): Xaa can be any naturally occurring amino acid
  VARIANT (13)..(13): Xaa can be any naturally occurring amino acid
  VARIANT (14)..(14): Xaa can be any naturally occurring amino acid
  VARIANT (16)..(16): Xaa can be any naturally occurring amino acid except Pro or Gly
  VARIANT (18)..(18): Xaa can be any naturally occurring amino acid
  VARIANT (19)..(19): Xaa can be any naturally occurring amino acid
  VARIANT (20)..(20): Xaa can be any naturally occurring amino acid
  VARIANT (22)..(22): Xaa can be any naturally occurring amino acid except Pro or Gly
  VARIANT (24)..(24): Xaa can be any naturally occurring amino acid
  VARIANT (25)..(25): Xaa can be any naturally occurring amino acid
  VARIANT (26)..(26): Xaa can be any naturally occurring amino acid
  VARIANT (28)..(28): Xaa can be any naturally occurring amino acid except Pro or Gly
  VARIANT (30)..(30): Xaa can be any naturally occurring amino acid
  VARIANT (31)..(31): Xaa can be any naturally occurring amino acid
  VARIANT (32)..(32): Xaa can be any naturally occurring amino acid
  VARIANT (34)..(34): Xaa can be any naturally occurring amino acid except Pro or Gly
  VARIANT (36)..(36): Xaa can be any naturally occurring amino acid
  VARIANT (37)..(37): Xaa can be any naturally occurring amino acid
  VARIANT (38)..(38): Xaa can be any naturally occurring amino acid
  VARIANT (40)..(40): Xaa can be any naturally occurring amino acid except Pro or Gly
  VARIANT (42)..(42): Xaa can be any naturally occurring amino acid
  VARIANT (43)..(43): Xaa can be any naturally occurring amino acid
  VARIANT (44)..(44): Xaa can be any naturally occurring amino acid
  VARIANT (46)..(46): Xaa can be any naturally occurring amino acid except Pro or Gly
  VARIANT (48)..(48): Xaa can be any naturally occurring amino acid
  VARIANT (49)..(49): Xaa can be any naturally occurring amino acid
  VARIANT (50)..(50): Xaa can be any naturally occurring amino acid
  VARIANT (52)..(52): Xaa can be any naturally occurring amino acid except Pro or Gly
  VARIANT (54)..(54): Xaa can be any naturally occurring amino acid
  VARIANT (55)..(55): Xaa can be any naturally occurring amino acid
  VARIANT (56)..(56): Xaa can be any naturally occurring amino acid
  VARIANT (58)..(58): Xaa can be any naturally occurring amino acid except Pro or Gly
  VARIANT (60)..(60): Xaa can be any naturally occurring amino acid
  VARIANT (61)..(960): May be present or absent in groups of the repeat unit Xaa Xaa Pro Xaa Gly Xaa Xaa
  VARIANT (61)..(61): Xaa can be any naturally occurring amino acid
  VARIANT (62)..(62): Xaa can be any naturally occurring amino acid
  VARIANT (64)..(64): Xaa can be any naturally occurring amino acid except Pro or Gly
  VARIANT (66)..(66): Xaa can be any naturally occurring amino acid
  VARIANT (67)..(67): Xaa can be any naturally occurring amino acid
  VARIANT (68)..(68): Xaa can be any naturally occurring amino acid
  VARIANT (70)..(70): Xaa can be any naturally occurring amino acid except Pro or Gly
  VARIANT (72)..(72): Xaa can be any naturally occurring amino acid
  VARIANT (73)..(73): Xaa can be any naturally occurring amino acid
  VARIANT (74)..(74): Xaa can be any naturally occurring amino acid
  VARIANT (76)..(76): Xaa can be any naturally occurring amino acid except Pro or Gly
  VARIANT (78)..(78): Xaa can be any naturally occurring amino acid
  VARIANT (79)..(79): Xaa can be any naturally occurring amino acid
  VARIANT (80)..(80): Xaa can be any naturally occurring amino acid
  VARIANT (82)..(82): Xaa can be any naturally occurring amino acid except Pro or Gly
  VARIANT (84)..(84): Xaa can be any naturally occurring amino acid
  VARIANT (85)..(85): Xaa can be any naturally occurring amino acid
  VARIANT (86)..(86): Xaa can be any naturally occurring amino acid
  VARIANT (88)..(88): Xaa can be any naturally occurring amino acid except Pro or Gly
  VARIANT (90)..(90): Xaa can be any naturally occurring amino acid
  VARIANT (91)..(91): Xaa can be any naturally occurring amino acid
  VARIANT (92)..(92): Xaa can be any naturally occurring amino acid
  VARIANT (94)..(94): Xaa can be any naturally occurring amino acid except Pro or Gly
  VARIANT (96)..(96): Xaa can be any naturally occurring amino acid
  VARIANT (97)..(97): Xaa can be any naturally occurring amino acid
  VARIANT (98)..(98): Xaa can be any naturally occurring amino acid
  VARIANT (100)..(100): Xaa can be any naturally occurring amino acid except Pro or Gly
  VARIANT (102)..(102): Xaa can be any naturally occurring amino acid
  VARIANT (103)..(103): Xaa can be any naturally occurring amino acid
  VARIANT (104)..(104): Xaa can be any naturally occurring amino acid
  VARIANT (106)..(106): Xaa can be any naturally occurring amino acid except Pro or Gly
  VARIANT (108)..(108): Xaa can be any naturally occurring amino acid
  VARIANT (109)..(109): Xaa can be any naturally occurring amino acid
  VARIANT (110)..(110): Xaa can be any naturally occurring amino acid
  VARIANT (112)..(112): Xaa can be any naturally occurring amino acid except Pro or Gly
  VARIANT (114)..(114): Xaa can be any naturally occurring amino acid
  VARIANT (115)..(115): Xaa can be any naturally occurring amino acid
  VARIANT (116)..(116): Xaa can be any naturally occurring amino acid
  VARIANT (118)..(118): Xaa can be any naturally occurring amino acid except Pro or Gly
  VARIANT (120)..(120): Xaa can be any naturally occurring amino acid
  VARIANT (121)..(121): Xaa can be any naturally occurring amino acid
  VARIANT (122)..(122): Xaa can be any naturally occurring amino acid
  VARIANT (124)..(124): Xaa can be any naturally occurring amino acid except Pro or Gly
  VARIANT (126)..(126): Xaa can be any naturally occurring amino acid
  VARIANT (127)..(127): Xaa can be any naturally occurring amino acid
  VARIANT (128)..(128): Xaa can be any naturally occurring amino acid
  VARIANT (130)..(130): Xaa can be any naturally occurring amino acid except Pro or Gly
  VARIANT (132)..(132): Xaa can be any naturally occurring amino acid
  VARIANT (133)..(133): Xaa can be any naturally occurring amino acid
  VARIANT (134)..(134): Xaa can be any naturally occurring amino acid
  VARIANT (136)..(136): Xaa can be any naturally occurring amino acid except Pro or Gly
  VARIANT (138)..(138): Xaa can be any naturally occurring amino acid
  VARIANT (139)..(139): Xaa can be any naturally occurring amino acid
  VARIANT (140)..(140): Xaa can be any naturally occurring amino acid
  VARIANT (142)..(142): Xaa can be any naturally occurring amino acid except Pro or Gly
  VARIANT (144)..(144): Xaa can be any naturally occurring amino acid
  VARIANT (145)..(145): Xaa can be any naturally occurring amino acid
  VARIANT (146)..(146): Xaa can be any naturally occurring amino acid
  VARIANT (148)..(148): Xaa can be any naturally occurring amino acid except Pro or Gly
  VARIANT (150)..(150): Xaa can be any naturally occurring amino acid
  VARIANT (151)..(151): Xaa can be any naturally occurring amino acid
  VARIANT (152)..(152): Xaa can be any naturally occurring amino acid
  VARIANT (154)..(154): Xaa can be any naturally occurring amino acid except Pro or Gly
  VARIANT (156)..(156): Xaa can be any naturally occurring amino acid
  VARIANT (157)..(157): Xaa can be any naturally occurring amino acid
  VARIANT (158)..(158): Xaa can be any naturally occurring amino acid
  VARIANT (160)..(160): Xaa can be any naturally occurring amino acid except Pro or Gly
  VARIANT (162)..(162): Xaa can be any naturally occurring amino acid
  VARIANT (163)..(163): Xaa can be any naturally occurring amino acid
  VARIANT (164)..(164): Xaa can be any naturally occurring amino acid
  VARIANT (166)..(166): Xaa can be any naturally occurring amino acid except Pro or Gly
  VARIANT (168)..(168): Xaa can be any naturally occurring amino acid
  VARIANT (169)..(169): Xaa can be any naturally occurring amino acid
  VARIANT (170)..(170): Xaa can be any naturally occurring amino acid
  VARIANT (172)..(172): Xaa can be any naturally occurring amino acid except Pro or Gly
  VARIANT (174)..(174): Xaa can be any naturally occurring amino acid
  VARIANT (175)..(175): Xaa can be any naturally occurring amino acid
  VARIANT (176)..(176): Xaa can be any naturally occurring amino acid
  VARIANT (178)..(178): Xaa can be any naturally occurring amino acid except Pro or Gly
  VARIANT (180)..(180): Xaa can be any naturally occurring amino acid
  VARIANT (181)..(181): Xaa can be any naturally occurring amino acid
  VARIANT (182)..(182): Xaa can be any naturally occurring amino acid
  VARIANT (184)..(184): Xaa can be any naturally occurring amino acid except Pro or Gly
  VARIANT (186)..(186): Xaa can be any naturally occurring amino acid
  VARIANT (187)..(187): Xaa can be any naturally occurring amino acid
  VARIANT (188)..(188): Xaa can be any naturally occurring amino acid
  VARIANT (190)..(190): Xaa can be any naturally occurring amino acid except Pro or Gly
  VARIANT (192)..(192): Xaa can be any naturally occurring amino acid
  VARIANT (193)..(193): Xaa can be any naturally occurring amino acid
  VARIANT (194)..(194): Xaa can be any naturally occurring amino acid
  VARIANT (196)..(196): Xaa can be any naturally occurring amino acid except Pro or Gly
  VARIANT (198)..(198): Xaa can be any naturally occurring amino acid
  VARIANT (199)..(199): Xaa can be any naturally occurring amino acid
  VARIANT (200)..(200): Xaa can be any naturally occurring amino acid
  VARIANT (202)..(202): Xaa can be any naturally occurring amino acid except Pro or Gly
  VARIANT (204)..(204): Xaa can be any naturally occurring amino acid
  VARIANT (205)..(205): Xaa can be any naturally occurring amino acid
  VARIANT (206)..(206): Xaa can be any naturally occurring amino acid
  VARIANT (208)..(208): Xaa can be any naturally occurring amino acid except Pro or Gly
  VARIANT (210)..(210): Xaa can be any naturally occurring amino acid
  VARIANT (211)..(211): Xaa can be any naturally occurring amino acid
  VARIANT (212)..(212): Xaa can be any naturally occurring amino acid
  VARIANT (214)..(214): Xaa can be any naturally occurring amino acid except Pro or Gly
  VARIANT (216)..(216): Xaa can be any naturally occurring amino acid
  VARIANT (217)..(217): Xaa can be any naturally occurring amino acid
  VARIANT (218)..(218): Xaa can be any naturally occurring amino acid
  VARIANT (220)..(220): Xaa can be any naturally occurring amino acid except Pro or Gly
  VARIANT (222)..(222): Xaa can be any naturally occurring amino acid
  VARIANT (223)..(223): Xaa can be any naturally occurring amino acid
  VARIANT (224)..(224): Xaa can be any naturally occurring amino acid
  VARIANT (226)..(226): Xaa can be any naturally occurring amino acid except Pro or Gly
  VARIANT (228)..(228): Xaa can be any naturally occurring amino acid
  VARIANT (229)..(229): Xaa can be any naturally occurring amino acid
  VARIANT (230)..(230): Xaa can be any naturally occurring amino acid
  VARIANT (232)..(232): Xaa can be any naturally occurring amino acid except Pro or Gly
  VARIANT (234)..(234): Xaa can be any naturally occurring amino acid
  VARIANT (235)..(235): Xaa can be any naturally occurring amino acid
  VARIANT (236)..(236): Xaa can be any naturally occurring amino acid
  VARIANT (238)..(238): Xaa can be any naturally occurring amino acid except Pro or Gly
  VARIANT (240)..(240): Xaa can be any naturally occurring amino acid
  VARIANT (241)..(241): Xaa can be any naturally occurring amino acid
  VARIANT (242)..(242): Xaa can be any naturally occurring amino acid
  VARIANT (244)..(244): Xaa can be any naturally occurring amino acid except Pro or Gly
  VARIANT (246)..(246): Xaa can be any naturally occurring amino acid
  VARIANT (247)..(247): Xaa can be any naturally occurring amino acid
  VARIANT (248)..(248): Xaa can be any naturally occurring amino acid
  VARIANT (250)..(250): Xaa can be any naturally occurring amino acid except Pro or Gly
  VARIANT (252)..(252): Xaa can be any naturally occurring amino acid
  VARIANT (253)..(253): Xaa can be any naturally occurring amino acid
  VARIANT (254)..(254): Xaa can be any naturally occurring amino acid
  VARIANT (256)..(256): Xaa can be any naturally occurring amino acid except Pro or Gly
  VARIANT (258)..(258): Xaa can be any naturally occurring amino acid
  VARIANT (259)..(259): Xaa can be any naturally occurring amino acid
  VARIANT (260)..(260): Xaa can be any naturally occurring amino acid
  VARIANT (262)..(262): Xaa can be any naturally occurring amino acid except Pro or Gly
  VARIANT (264)..(264): Xaa can be any naturally occurring amino acid
  VARIANT (265)..(265): Xaa can be any naturally occurring amino acid
  VARIANT (266)..(266): Xaa can be any naturally occurring amino acid
  VARIANT (268)..(268): Xaa can be any naturally occurring amino acid except Pro or Gly
  VARIANT (270)..(270): Xaa can be any naturally occurring amino acid
  VARIANT (271)..(271): Xaa can be any naturally occurring amino acid
  VARIANT (272)..(272): Xaa can be any naturally occurring amino acid
  VARIANT (274)..(274): Xaa can be any naturally occurring amino acid except Pro or Gly
  VARIANT (276)..(276): Xaa can be any naturally occurring amino acid
  VARIANT (277)..(277): Xaa can be any naturally occurring amino acid
  VARIANT (278)..(278): Xaa can be any naturally occurring amino acid
  VARIANT (280)..(280): Xaa can be any naturally occurring amino acid except Pro or Gly
  VARIANT (282)..(282): Xaa can be any naturally occurring amino acid
  VARIANT (283)..(283): Xaa can be any naturally occurring amino acid
  VARIANT (284)..(284): Xaa can be any naturally occurring amino acid
  VARIANT (286)..(286): Xaa can be any naturally occurring amino acid except Pro or Gly
  VARIANT (288)..(288): Xaa can be any naturally occurring amino acid
  VARIANT (289)..(289): Xaa can be any naturally occurring amino acid
  VARIANT (290)..(290): Xaa can be any naturally occurring amino acid
  VARIANT (292)..(292): Xaa can be any naturally occurring amino acid except Pro or Gly
  VARIANT (294)..(294): Xaa can be any naturally occurring amino acid
  VARIANT (295)..(295): Xaa can be any naturally occurring amino acid
  VARIANT (296)..(296): Xaa can be any naturally occurring amino acid
  VARIANT (298)..(298): Xaa can be any naturally occurring amino acid except Pro or Gly
  VARIANT (300)..(300): Xaa can be any naturally occurring amino acid
  VARIANT (301)..(301): Xaa can be any naturally occurring amino acid
  VARIANT (302)..(302): Xaa can be any naturally occurring amino acid
  VARIANT (304)..(304): Xaa can be any naturally occurring amino acid except Pro or Gly
  VARIANT (306)..(306): Xaa can be any naturally occurring amino acid
  VARIANT (307)..(307): Xaa can be any naturally occurring amino acid
  VARIANT (308)..(308): Xaa can be any naturally occurring amino acid
  VARIANT (310)..(310): Xaa can be any naturally occurring amino acid except Pro or Gly
  VARIANT (312)..(312): Xaa can be any naturally occurring amino acid
  VARIANT (313)..(313): Xaa can be any naturally occurring amino acid
  VARIANT (314)..(314): Xaa can be any naturally occurring amino acid
  VARIANT (316)..(316): Xaa can be any naturally occurring amino acid except Pro or Gly
  VARIANT (318)..(318): Xaa can be any naturally occurring amino acid
  VARIANT (319)..(319): Xaa can be any naturally occurring amino acid
  VARIANT (320)..(320): Xaa can be any naturally occurring amino acid
  VARIANT (322)..(322): Xaa can be any naturally occurring amino acid except Pro or Gly
  VARIANT (324)..(324): Xaa can be any naturally occurring amino acid
  VARIANT (325)..(325): Xaa can be any naturally occurring amino acid
  VARIANT (326)..(326): Xaa can be any naturally occurring amino acid
  VARIANT (328)..(328): Xaa can be any naturally occurring amino acid except Pro or Gly
  VARIANT (330)..(330): Xaa can be any naturally occurring amino acid
  VARIANT (331)..(331): Xaa can be any naturally occurring amino acid
  VARIANT (332)..(332): Xaa can be any naturally occurring amino acid
  VARIANT (334)..(334): Xaa can be any naturally occurring amino acid except Pro or Gly
  VARIANT (336)..(336): Xaa can be any naturally occurring amino acid
  VARIANT (337)..(337): Xaa can be any naturally occurring amino acid
  VARIANT (338)..(338): Xaa can be any naturally occurring amino acid
  VARIANT (340)..(340): Xaa can be any naturally occurring amino acid except Pro or Gly
  VARIANT (342)..(342): Xaa can be any naturally occurring amino acid
  VARIANT (343)..(343): Xaa can be any naturally occurring amino acid
  VARIANT (344)..(344): Xaa can be any naturally occurring amino acid
  VARIANT (346)..(346): Xaa can be any naturally occurring amino acid except Pro or Gly
  VARIANT (348)..(348): Xaa can be any naturally occurring amino acid
  VARIANT (349)..(349): Xaa can be any naturally occurring amino acid
  VARIANT (350)..(350): Xaa can be any naturally occurring amino acid
  VARIANT (352)..(352): Xaa can be any naturally occurring amino acid except Pro or Gly
  VARIANT (354)..(354): Xaa can be any naturally occurring amino acid
  VARIANT (355)..(355): Xaa can be any naturally occurring amino acid
  VARIANT (356)..(356): Xaa can be any naturally occurring amino acid
  VARIANT (358)..(358): Xaa can be any naturally occurring amino acid except Pro or Gly
  VARIANT (360)..(360): Xaa can be any naturally occurring amino acid
  VARIANT (361)..(361): Xaa can be any naturally occurring amino acid
  VARIANT (362)..(362): Xaa can be any naturally occurring amino acid
  VARIANT (364)..(364): Xaa can be any naturally occurring amino acid except Pro or Gly
  VARIANT (366)..(366): Xaa can be any naturally occurring amino acid
  VARIANT (367)..(367): Xaa can be any naturally occurring amino acid
  VARIANT (368)..(368): Xaa can be any naturally occurring amino acid
  VARIANT (370)..(370): Xaa can be any naturally occurring amino acid except Pro or Gly
  VARIANT (372)..(372): Xaa can be any naturally occurring amino acid
  VARIANT (373)..(373): Xaa can be any naturally occurring amino acid
  VARIANT (374)..(374): Xaa can be any naturally occurring amino acid
  VARIANT (376)..(376): Xaa can be any naturally occurring amino acid except Pro or Gly
  VARIANT (378)..(378): Xaa can be any naturally occurring amino acid
  VARIANT (379)..(379): Xaa can be any naturally occurring amino acid
  VARIANT (380)..(380): Xaa can be any naturally occurring amino acid
  VARIANT (382)..(382): Xaa can be any naturally occurring amino acid except Pro or Gly
  VARIANT (384)..(384): Xaa can be any naturally occurring amino acid
  VARIANT (385)..(385): Xaa can be any naturally occurring amino acid
  VARIANT (386)..(386): Xaa can be any naturally occurring amino acid
  VARIANT (388)..(388): Xaa can be any naturally occurring amino acid except Pro or Gly
  VARIANT (390)..(390): Xaa can be any naturally occurring amino acid
  VARIANT (391)..(391): Xaa can be any naturally occurring amino acid
  VARIANT (392)..(392): Xaa can be any naturally occurring amino acid
  VARIANT (394)..(394): Xaa can be any naturally occurring amino acid except Pro or Gly
  VARIANT (396)..(396): Xaa can be any naturally occurring amino acid
  VARIANT (397)..(397): Xaa can be any naturally occurring amino acid
  VARIANT (398)..(398): Xaa can be any naturally occurring amino acid
  VARIANT (400)..(400): Xaa can be any naturally occurring amino acid except Pro or Gly
  VARIANT (402)..(402): Xaa can be any naturally occurring amino acid
  VARIANT (403)..(403): Xaa can be any naturally occurring amino acid
  VARIANT (404)..(404): Xaa can be any naturally occurring amino acid
  VARIANT (406)..(406): Xaa can be any naturally occurring amino acid except Pro or Gly
  VARIANT (408)..(408): Xaa can be any naturally occurring amino acid
  VARIANT (409)..(409): Xaa can be any naturally occurring amino acid
  VARIANT (410)..(410): Xaa can be any naturally occurring amino acid
  VARIANT (412)..(412): Xaa can be any naturally occurring amino acid except Pro or Gly
  VARIANT (414)..(414): Xaa can be any naturally occurring amino acid
  VARIANT (415)..(415): Xaa can be any naturally occurring amino acid
  VARIANT (416)..(416): Xaa can be any naturally occurring amino acid
  VARIANT (418)..(418): Xaa can be any naturally occurring amino acid except Pro or Gly
  VARIANT (420)..(420): Xaa can be any naturally occurring amino acid
  VARIANT (421)..(421): Xaa can be any naturally occurring amino acid
  VARIANT (422)..(422): Xaa can be any naturally occurring amino acid
  VARIANT (424)..(424): Xaa can be any naturally occurring amino acid except Pro or Gly
  VARIANT (426)..(426): Xaa can be any naturally occurring amino acid
  VARIANT (427)..(427): Xaa can be any naturally occurring amino acid
  VARIANT (428)..(428): Xaa can be any naturally occurring amino acid
  VARIANT (430)..(430): Xaa can be any naturally occurring amino acid except Pro or Gly
  VARIANT (432)..(432): Xaa can be any naturally occurring amino acid
  VARIANT (433)..(433): Xaa can be any naturally occurring amino acid
  VARIANT (434)..(434): Xaa can be any naturally occurring amino acid
  VARIANT (436)..(436): Xaa can be any naturally occurring amino acid except Pro or Gly
  VARIANT (438)..(438): Xaa can be any naturally occurring amino acid
  VARIANT (439)..(439): Xaa can be any naturally occurring amino acid
  VARIANT (440)..(440): Xaa can be any naturally occurring amino acid
  VARIANT (442)..(442): Xaa can be any naturally occurring amino acid except Pro or Gly
  VARIANT (444)..(444): Xaa can be any naturally occurring amino acid
  VARIANT (445)..(445): Xaa can be any naturally occurring amino acid
  VARIANT (446)..(446): Xaa can be any naturally occurring amino acid
  VARIANT (448)..(448): Xaa can be any naturally occurring amino acid except Pro or Gly
  VARIANT (450)..(450): Xaa can be any naturally occurring amino acid
  VARIANT (451)..(451): Xaa can be any naturally occurring amino acid
  VARIANT (452)..(452): Xaa can be any naturally occurring amino acid
  VARIANT (454)..(454): Xaa can be any naturally occurring amino acid except Pro or Gly
  VARIANT (456)..(456): Xaa can be any naturally occurring amino acid
  VARIANT (457)..(457): Xaa can be any naturally occurring amino acid
  VARIANT (458)..(458): Xaa can be any naturally occurring amino acid
  VARIANT (460)..(460): Xaa can be any naturally occurring amino acid except Pro or Gly
  VARIANT (462)..(462): Xaa can be any naturally occurring amino acid
  VARIANT (463)..(463): Xaa can be any naturally occurring amino acid
  VARIANT (464)..(464): Xaa can be any naturally occurring amino acid
  VARIANT (466)..(466): Xaa can be any naturally occurring amino acid except Pro or Gly
  VARIANT (468)..(468): Xaa can be any naturally occurring amino acid
  VARIANT (469)..(469): Xaa can be any naturally occurring amino acid
  VARIANT (470)..(470): Xaa can be any naturally occurring amino acid
  VARIANT (472)..(472): Xaa can be any naturally occurring amino acid except Pro or Gly
  VARIANT (474)..(474): Xaa can be any naturally occurring amino acid
  VARIANT (475)..(475): Xaa can be any naturally occurring amino acid
  VARIANT (476)..(476): Xaa can be any naturally occurring amino acid
  VARIANT (478)..(478): Xaa can be any naturally occurring amino acid except Pro or Gly
  VARIANT (480)..(480): Xaa can be any naturally occurring amino acid
  VARIANT (481)..(481): Xaa can be any naturally occurring amino acid
  VARIANT (482)..(482): Xaa can be any naturally occurring amino acid
  VARIANT (484)..(484): Xaa can be any naturally occurring amino acid except Pro or Gly
  VARIANT (486)..(486): Xaa can be any naturally occurring amino acid
  VARIANT (487)..(487): Xaa can be any naturally occurring amino acid
  VARIANT (488)..(488): Xaa can be any naturally occurring amino acid
  VARIANT (490)..(490): Xaa can be any naturally occurring amino acid except Pro or Gly
  VARIANT (492)..(492): Xaa can be any naturally occurring amino acid
  VARIANT (493)..(493): Xaa can be any naturally occurring amino acid
  VARIANT (494)..(494): Xaa can be any naturally occurring amino acid
  VARIANT (496)..(496): Xaa can be any naturally occurring amino acid except Pro or Gly
  VARIANT (498)..(498): Xaa can be any naturally occurring amino acid
  VARIANT (499)..(499): Xaa can be any naturally occurring amino acid
  VARIANT (500)..(500): Xaa can be any naturally occurring amino acid
  VARIANT (502)..(502): Xaa can be any naturally occurring amino acid except Pro or Gly
  VARIANT (504)..(504): Xaa can be any naturally occurring amino acid
  VARIANT (505)..(505): Xaa can be any naturally occurring amino acid
  VARIANT (506)..(506): Xaa can be any naturally occurring amino acid
  VARIANT (508)..(508): Xaa can be any naturally occurring amino acid except Pro or Gly
  VARIANT (510)..(510): Xaa can be any naturally occurring amino acid
  VARIANT (511)..(511): Xaa can be any naturally occurring amino acid
  VARIANT (512)..(512): Xaa can be any naturally occurring amino acid
  VARIANT (514)..(514): Xaa can be any naturally occurring amino acid except Pro or Gly
  VARIANT (516)..(516): Xaa can be any naturally occurring amino acid
  VARIANT (517)..(517): Xaa can be any naturally occurring amino acid
  VARIANT (518)..(518): Xaa can be any naturally occurring amino acid
  VARIANT (520)..(520): Xaa can be any naturally occurring amino acid except Pro or Gly
  VARIANT (522)..(522): Xaa can be any naturally occurring amino acid
  VARIANT (523)..(523): Xaa can be any naturally occurring amino acid
  VARIANT (524)..(524): Xaa can be any naturally occurring amino acid
  VARIANT (526)..(526): Xaa can be any naturally occurring amino acid except Pro or Gly
  VARIANT (528)..(528): Xaa can be any naturally occurring amino acid
  VARIANT (529)..(529): Xaa can be any naturally occurring amino acid
  VARIANT (530)..(530): Xaa can be any naturally occurring amino acid
  VARIANT (532)..(532): Xaa can be any naturally occurring amino acid except Pro or Gly
  VARIANT (534)..(534): Xaa can be any naturally occurring amino acid
  VARIANT (535)..(535): Xaa can be any naturally occurring amino acid
  VARIANT (536)..(536): Xaa can be any naturally occurring amino acid
  VARIANT (538)..(538): Xaa can be any naturally occurring amino acid except Pro or Gly
  VARIANT (540)..(540): Xaa can be any naturally occurring amino acid
  VARIANT (541)..(541): Xaa can be any naturally occurring amino acid
  VARIANT (542)..(542): Xaa can be any naturally occurring amino acid
  VARIANT (544)..(544): Xaa can be any naturally occurring amino acid except Pro or Gly
  VARIANT (546)..(546): Xaa can be any naturally occurring amino acid
  VARIANT (547)..(547): Xaa can be any naturally occurring amino acid
  VARIANT (548)..(548): Xaa can be any naturally occurring amino acid
  VARIANT (550)..(550): Xaa can be any naturally occurring amino acid except Pro or Gly
  VARIANT (552)..(552): Xaa can be any naturally occurring amino acid
  VARIANT (553)..(553): Xaa can be any naturally occurring amino acid
  VARIANT (554)..(554): Xaa can be any naturally occurring amino acid
  VARIANT (556)..(556): Xaa can be any naturally occurring amino acid except Pro or Gly
  VARIANT (558)..(558): Xaa can be any naturally occurring amino acid
  VARIANT (559)..(559): Xaa can be any naturally occurring amino acid
  VARIANT (560)..(560): Xaa can be any naturally occurring amino acid
  VARIANT (562)..(562): Xaa can be any naturally occurring amino acid except Pro or Gly
  VARIANT (564)..(564): Xaa can be any naturally occurring amino acid
  VARIANT (565)..(565): Xaa can be any naturally occurring amino acid
  VARIANT (566)..(566): Xaa can be any naturally occurring amino acid
  VARIANT (568)..(568): Xaa can be any naturally occurring amino acid except Pro or Gly
  VARIANT (570)..(570): Xaa can be any naturally occurring amino acid
  VARIANT (571)..(571): Xaa can be any naturally occurring amino acid
  VARIANT (572)..(572): Xaa can be any naturally occurring amino acid
  VARIANT (574)..(574): Xaa can be any naturally occurring amino acid except Pro or Gly
  VARIANT (576)..(576): Xaa can be any naturally occurring amino acid
  VARIANT (577)..(577): Xaa can be any naturally occurring amino acid
  VARIANT (578)..(578): Xaa can be any naturally occurring amino acid
  VARIANT (580)..(580): Xaa can be any naturally occurring amino acid except Pro or Gly
  VARIANT (582)..(582): Xaa can be any naturally occurring amino acid
  VARIANT (583)..(583): Xaa can be any naturally occurring amino acid
  VARIANT (584)..(584): Xaa can be any naturally occurring amino acid
  VARIANT (586)..(586): Xaa can be any naturally occurring amino acid except Pro or Gly
  VARIANT (588)..(588): Xaa can be any naturally occurring amino acid
  VARIANT (589)..(589): Xaa can be any naturally occurring amino acid
  VARIANT (590)..(590): Xaa can be any naturally occurring amino acid
  VARIANT (592)..(592): Xaa can be any naturally occurring amino acid except Pro or Gly
  VARIANT (594)..(594): Xaa can be any naturally occurring amino acid
  VARIANT (595)..(595): Xaa can be any naturally occurring amino acid
  VARIANT (596)..(596): Xaa can be any naturally occurring amino acid
  VARIANT (598)..(598): Xaa can be any naturally occurring amino acid except Pro or Gly
  VARIANT (600)..(600): Xaa can be any naturally occurring amino acid
  VARIANT (601)..(601): Xaa can be any naturally occurring amino acid
  VARIANT (602)..(602): Xaa can be any naturally occurring amino acid
  VARIANT (604)..(604): Xaa can be any naturally occurring amino acid except Pro or Gly
  VARIANT (606)..(606): Xaa can be any naturally occurring amino acid
  VARIANT (607)..(607): Xaa can be any naturally occurring amino acid
  VARIANT (608)..(608): Xaa can be any naturally occurring amino acid
  VARIANT (610)..(610): Xaa can be any naturally occurring amino acid except Pro or Gly
  VARIANT (612)..(612): Xaa can be any naturally occurring amino acid
  VARIANT (613)..(613): Xaa can be any naturally occurring amino acid
  VARIANT (614)..(614): Xaa can be any naturally occurring amino acid
  VARIANT (616)..(616): Xaa can be any naturally occurring amino acid except Pro or Gly
  VARIANT (618)..(618): Xaa can be any naturally occurring amino acid
  VARIANT (619)..(619): Xaa can be any naturally occurring amino acid
  VARIANT (620)..(620): Xaa can be any naturally occurring amino acid
  VARIANT (622)..(622): Xaa can be any naturally occurring amino acid except Pro or Gly
  VARIANT (624)..(624): Xaa can be any naturally occurring amino acid
  VARIANT (625)..(625): Xaa can be any naturally occurring amino acid
  VARIANT (626)..(626): Xaa can be any naturally occurring amino acid
  VARIANT (628)..(628): Xaa can be any naturally occurring amino acid except Pro or Gly
  VARIANT (630)..(630): Xaa can be any naturally occurring amino acid
  VARIANT (631)..(631): Xaa can be any naturally occurring amino acid
  VARIANT (632)..(632): Xaa can be any naturally occurring amino acid
  VARIANT (634)..(634): Xaa can be any naturally occurring amino acid except Pro or Gly
  VARIANT (636)..(636): Xaa can be any naturally occurring amino acid
  VARIANT (637)..(637): Xaa can be any naturally occurring amino acid
  VARIANT (638)..(638): Xaa can be any naturally occurring amino acid
  VARIANT (640)..(640): Xaa can be any naturally occurring amino acid except Pro or Gly
  VARIANT (642)..(642): Xaa can be any naturally occurring amino acid
  VARIANT (643)..(643): Xaa can be any naturally occurring amino acid
  VARIANT (644)..(644): Xaa can be any naturally occurring amino acid
  VARIANT (646)..(646): Xaa can be any naturally occurring amino acid except Pro or Gly
  VARIANT (648)..(648): Xaa can be any naturally occurring amino acid
  VARIANT (649)..(649): Xaa can be any naturally occurring amino acid
  VARIANT (650)..(650): Xaa can be any naturally occurring amino acid
  VARIANT (652)..(652): Xaa can be any naturally occurring amino acid except Pro or Gly
  VARIANT (654)..(654): Xaa can be any naturally occurring amino acid
  VARIANT (655)..(655): Xaa can be any naturally occurring amino acid
  VARIANT (656)..(656): Xaa can be any naturally occurring amino acid
  VARIANT (658)..(658): Xaa can be any naturally occurring amino acid except Pro or Gly
  VARIANT (660)..(660): Xaa can be any naturally occurring amino acid
  VARIANT (661)..(661): Xaa can be any naturally occurring amino acid
  VARIANT (662)..(662): Xaa can be any naturally occurring amino acid
  VARIANT (664)..(664): Xaa can be any naturally occurring amino acid except Pro or Gly
  VARIANT (666)..(666): Xaa can be any naturally occurring amino acid
  VARIANT (667)..(667): Xaa can be any naturally occurring amino acid
  VARIANT (668)..(668): Xaa can be any naturally occurring amino acid
  VARIANT (670)..(670): Xaa can be any naturally occurring amino acid except Pro or Gly
  VARIANT (672)..(672): Xaa can be any naturally occurring amino acid
  VARIANT (673)..(673): Xaa can be any naturally occurring amino acid
  VARIANT (674)..(674): Xaa can be any naturally occurring amino acid
  VARIANT (676)..(676): Xaa can be any naturally occurring amino acid except Pro or Gly
  VARIANT (678)..(678): Xaa can be any naturally occurring amino acid
  VARIANT (679)..(679): Xaa can be any naturally occurring amino acid
  VARIANT (680)..(680): Xaa can be any naturally occurring amino acid
  VARIANT (682)..(682): Xaa can be any naturally occurring amino acid except Pro or Gly
  VARIANT (684)..(684): Xaa can be any naturally occurring amino acid
  VARIANT (685)..(685): Xaa can be any naturally occurring amino acid
  VARIANT (686)..(686): Xaa can be any naturally occurring amino acid
  VARIANT (688)..(688): Xaa can be any naturally occurring amino acid except Pro or Gly
  VARIANT (690)..(690): Xaa can be any naturally occurring amino acid
  VARIANT (691)..(691): Xaa can be any naturally occurring amino acid
  VARIANT (692)..(692): Xaa can be any naturally occurring amino acid
  VARIANT (694)..(694): Xaa can be any naturally occurring amino acid except Pro or Gly
  VARIANT (696)..(696): Xaa can be any naturally occurring amino acid
  VARIANT (697)..(697): Xaa can be any naturally occurring amino acid
  VARIANT (698)..(698): Xaa can be any naturally occurring amino acid
  VARIANT (700)..(700): Xaa can be any naturally occurring amino acid except Pro or Gly
  VARIANT (702)..(702): Xaa can be any naturally occurring amino acid
  VARIANT (703)..(703): Xaa can be any naturally occurring amino acid
  VARIANT (704)..(704): Xaa can be any naturally occurring amino acid
  VARIANT (706)..(706): Xaa can be any naturally occurring amino acid except Pro or Gly
  VARIANT (708)..(708): Xaa can be any naturally occurring amino acid
  VARIANT (709)..(709): Xaa can be any naturally occurring amino acid
  VARIANT (710)..(710): Xaa can be any naturally occurring amino acid
  VARIANT (712)..(712): Xaa can be any naturally occurring amino acid except Pro or Gly
  VARIANT (714)..(714): Xaa can be any naturally occurring amino acid
  VARIANT (715)..(715): Xaa can be any naturally occurring amino acid
  VARIANT (716)..(716): Xaa can be any naturally occurring amino acid
  VARIANT (718)..(718): Xaa can be any naturally occurring amino acid except Pro or Gly
  VARIANT (720)..(720): Xaa can be any naturally occurring amino acid
  VARIANT (721)..(721): Xaa can be any naturally occurring amino acid
  VARIANT (722)..(722): Xaa can be any naturally occurring amino acid
  VARIANT (724)..(724): Xaa can be any naturally occurring amino acid except Pro or Gly
  VARIANT (726)..(726): Xaa can be any naturally occurring amino acid
  VARIANT (727)..(727): Xaa can be any naturally occurring amino acid
  VARIANT (728)..(728): Xaa can be any naturally occurring amino acid
  VARIANT (730)..(730): Xaa can be any naturally occurring amino acid except Pro or Gly
  VARIANT (732)..(732): Xaa can be any naturally occurring amino acid
  VARIANT (733)..(733): Xaa can be any naturally occurring amino acid
  VARIANT (734)..(734): Xaa can be any naturally occurring amino acid
  VARIANT (736)..(736): Xaa can be any naturally occurring amino acid except Pro or Gly
  VARIANT (738)..(738): Xaa can be any naturally occurring amino acid
  VARIANT (739)..(739): Xaa can be any naturally occurring amino acid
  VARIANT (740)..(740): Xaa can be any naturally occurring amino acid
  VARIANT (742)..(742): Xaa can be any naturally occurring amino acid except Pro or Gly
  VARIANT (744)..(744): Xaa can be any naturally occurring amino acid
  VARIANT (745)..(745): Xaa can be any naturally occurring amino acid
  VARIANT (746)..(746): Xaa can be any naturally occurring amino acid
  VARIANT (748)..(748): Xaa can be any naturally occurring amino acid except Pro or Gly
  VARIANT (750)..(750): Xaa can be any naturally occurring amino acid
  VARIANT (751)..(751): Xaa can be any naturally occurring amino acid
  VARIANT (752)..(752): Xaa can be any naturally occurring amino acid
  VARIANT (754)..(754): Xaa can be any naturally occurring amino acid except Pro or Gly
  VARIANT (756)..(756): Xaa can be any naturally occurring amino acid
  VARIANT (757)..(757): Xaa can be any naturally occurring amino acid
  VARIANT (758)..(758): Xaa can be any naturally occurring amino acid
  VARIANT (760)..(760): Xaa can be any naturally occurring amino acid except Pro or Gly
  VARIANT (762)..(762): Xaa can be any naturally occurring amino acid
  VARIANT (763)..(763): Xaa can be any naturally occurring amino acid
  VARIANT (764)..(764): Xaa can be any naturally occurring amino acid
  VARIANT (766)..(766): Xaa can be any naturally occurring amino acid except Pro or Gly
  VARIANT (768)..(768): Xaa can be any naturally occurring amino acid
  VARIANT (769)..(769): Xaa can be any naturally occurring amino acid
  VARIANT (770)..(770): Xaa can be any naturally occurring amino acid
  VARIANT (772)..(772): Xaa can be any naturally occurring amino acid except Pro or Gly
  VARIANT (774)..(774): Xaa can be any naturally occurring amino acid
  VARIANT (775)..(775): Xaa can be any naturally occurring amino acid
  VARIANT (776)..(776): Xaa can be any naturally occurring amino acid
  VARIANT (778)..(778): Xaa can be any naturally occurring amino acid except Pro or Gly
  VARIANT (780)..(780): Xaa can be any naturally occurring amino acid
  VARIANT (781)..(781): Xaa can be any naturally occurring amino acid
  VARIANT (782)..(782): Xaa can be any naturally occurring amino acid
  VARIANT (784)..(784): Xaa can be any naturally occurring amino acid except Pro or Gly
  VARIANT (786)..(786): Xaa can be any naturally occurring amino acid
  VARIANT (787)..(787): Xaa can be any naturally occurring amino acid
  VARIANT (788)..(788): Xaa can be any naturally occurring amino acid
  VARIANT (790)..(790): Xaa can be any naturally occurring amino acid except Pro or Gly
  VARIANT (792)..(792): Xaa can be any naturally occurring amino acid
  VARIANT (793)..(793): Xaa can be any naturally occurring amino acid
  VARIANT (794)..(794): Xaa can be any naturally occurring amino acid
  VARIANT (796)..(796): Xaa can be any naturally occurring amino acid except Pro or Gly
  VARIANT (798)..(798): Xaa can be any naturally occurring amino acid
  VARIANT (799)..(799): Xaa can be any naturally occurring amino acid
  VARIANT (800)..(800): Xaa can be any naturally occurring amino acid
  VARIANT (802)..(802): Xaa can be any naturally occurring amino acid except Pro or Gly
  VARIANT (804)..(804): Xaa can be any naturally occurring amino acid
  VARIANT (805)..(805): Xaa can be any naturally occurring amino acid
  VARIANT (806)..(806): Xaa can be any naturally occurring amino acid
  VARIANT (808)..(808): Xaa can be any naturally occurring amino acid except Pro or Gly
  VARIANT (810)..(810): Xaa can be any naturally occurring amino acid
  VARIANT (811)..(811): Xaa can be any naturally occurring amino acid
  VARIANT (812)..(812): Xaa can be any naturally occurring amino acid
  VARIANT (814)..(814): Xaa can be any naturally occurring amino acid except Pro or Gly
  VARIANT (816)..(816): Xaa can be any naturally occurring amino acid
  VARIANT (817)..(817): Xaa can be any naturally occurring amino acid
  VARIANT (818)..(818): Xaa can be any naturally occurring amino acid
  VARIANT (820)..(820): Xaa can be any naturally occurring amino acid except Pro or Gly
  VARIANT (822)..(822): Xaa can be any naturally occurring amino acid
  VARIANT (823)..(823): Xaa can be any naturally occurring amino acid
  VARIANT (824)..(824): Xaa can be any naturally occurring amino acid
  VARIANT (826)..(826): Xaa can be any naturally occurring amino acid except Pro or Gly
  VARIANT (828)..(828): Xaa can be any naturally occurring amino acid
  VARIANT (829)..(829): Xaa can be any naturally occurring amino acid
  VARIANT (830)..(830): Xaa can be any naturally occurring amino acid
  VARIANT (832)..(832): Xaa can be any naturally occurring amino acid except Pro or Gly
  VARIANT (834)..(834): Xaa can be any naturally occurring amino acid
  VARIANT (835)..(835): Xaa can be any naturally occurring amino acid
  VARIANT (836)..(836): Xaa can be any naturally occurring amino acid
  VARIANT (838)..(838): Xaa can be any naturally occurring amino acid except Pro or Gly
  VARIANT (840)..(840): Xaa can be any naturally occurring amino acid
  VARIANT (841)..(841): Xaa can be any naturally occurring amino acid
  VARIANT (842)..(842): Xaa can be any naturally occurring amino acid
  VARIANT (844)..(844): Xaa can be any naturally occurring amino acid except Pro or Gly
  VARIANT (846)..(846): Xaa can be any naturally occurring amino acid
  VARIANT (847)..(847): Xaa can be any naturally occurring amino acid
  VARIANT (848)..(848): Xaa can be any naturally occurring amino acid
  VARIANT (850)..(850): Xaa can be any naturally occurring amino acid except Pro or Gly
  VARIANT (852)..(852): Xaa can be any naturally occurring amino acid
  VARIANT (853)..(853): Xaa can be any naturally occurring amino acid
  VARIANT (854)..(854): Xaa can be any naturally occurring amino acid
  VARIANT (856)..(856): Xaa can be any naturally occurring amino acid except Pro or Gly
  VARIANT (858)..(858): Xaa can be any naturally occurring amino acid
  VARIANT (859)..(859): Xaa can be any naturally occurring amino acid
  VARIANT (860)..(860): Xaa can be any naturally occurring amino acid
  VARIANT (862)..(862): Xaa can be any naturally occurring amino acid except Pro or Gly
  VARIANT (864)..(864): Xaa can be any naturally occurring amino acid
  VARIANT (865)..(865): Xaa can be any naturally occurring amino acid
  VARIANT (866)..(866): Xaa can be any naturally occurring amino acid
  VARIANT (868)..(868): Xaa can be any naturally occurring amino acid except Pro or Gly
  VARIANT (870)..(870): Xaa can be any naturally occurring amino acid
  VARIANT (871)..(871): Xaa can be any naturally occurring amino acid
  VARIANT (872)..(872): Xaa can be any naturally occurring amino acid
  VARIANT (874)..(874): Xaa can be any naturally occurring amino acid except Pro or Gly
  VARIANT (876)..(876): Xaa can be any naturally occurring amino acid
  VARIANT (877)..(877): Xaa can be any naturally occurring amino acid
  VARIANT (878)..(878): Xaa can be any naturally occurring amino acid
  VARIANT (880)..(880): Xaa can be any naturally occurring amino acid except Pro or Gly
  VARIANT (882)..(882): Xaa can be any naturally occurring amino acid
  VARIANT (883)..(883): Xaa can be any naturally occurring amino acid
  VARIANT (884)..(884): Xaa can be any naturally occurring amino acid
  VARIANT (886)..(886): Xaa can be any naturally occurring amino acid except Pro or Gly
  VARIANT (888)..(888): Xaa can be any naturally occurring amino acid
  VARIANT (889)..(889): Xaa can be any naturally occurring amino acid
  VARIANT (890)..(890): Xaa can be any naturally occurring amino acid
  VARIANT (892)..(892): Xaa can be any naturally occurring amino acid except Pro or Gly
  VARIANT (894)..(894): Xaa can be any naturally occurring amino acid
  VARIANT (895)..(895): Xaa can be any naturally occurring amino acid
  VARIANT (896)..(896): Xaa can be any naturally occurring amino acid
  VARIANT (898)..(898): Xaa can be any naturally occurring amino acid except Pro or Gly
  VARIANT (900)..(900): Xaa can be any naturally occurring amino acid
  VARIANT (901)..(901): Xaa can be any naturally occurring amino acid
  VARIANT (902)..(902): Xaa can be any naturally occurring amino acid
  VARIANT (904)..(904): Xaa can be any naturally occurring amino acid except Pro or Gly
  VARIANT (906)..(906): Xaa can be any naturally occurring amino acid
  VARIANT (907)..(907): Xaa can be any naturally occurring amino acid
  VARIANT (908)..(908): Xaa can be any naturally occurring amino acid
  VARIANT (910)..(910): Xaa can be any naturally occurring amino acid except Pro or Gly
  VARIANT (912)..(912): Xaa can be any naturally occurring amino acid
  VARIANT (913)..(913): Xaa can be any naturally occurring amino acid
  VARIANT (914)..(914): Xaa can be any naturally occurring amino acid
  VARIANT (916)..(916): Xaa can be any naturally occurring amino acid except Pro or Gly
  VARIANT (918)..(918): Xaa can be any naturally occurring amino acid
  VARIANT (919)..(919): Xaa can be any naturally occurring amino acid
  VARIANT (920)..(920): Xaa can be any naturally occurring amino acid
  VARIANT (922)..(922): Xaa can be any naturally occurring amino acid except Pro or Gly
  VARIANT (924)..(924): Xaa can be any naturally occurring amino acid
  VARIANT (925)..(925): Xaa can be any naturally occurring amino acid
  VARIANT (926)..(926): Xaa can be any naturally occurring amino acid
  VARIANT (928)..(928): Xaa can be any naturally occurring amino acid except Pro or Gly
  VARIANT (930)..(930): Xaa can be any naturally occurring amino acid
  VARIANT (931)..(931): Xaa can be any naturally occurring amino acid
  VARIANT (932)..(932): Xaa can be any naturally occurring amino acid
  VARIANT (934)..(934): Xaa can be any naturally occurring amino acid except Pro or Gly
  VARIANT (936)..(936): Xaa can be any naturally occurring amino acid
  VARIANT (937)..(937): Xaa can be any naturally occurring amino acid
  VARIANT (938)..(938): Xaa can be any naturally occurring amino acid
  VARIANT (940)..(940): Xaa can be any naturally occurring amino acid except Pro or Gly
  VARIANT (942)..(942): Xaa can be any naturally occurring amino acid
  VARIANT (943)..(943): Xaa can be any naturally occurring amino acid
  VARIANT (944)..(944): Xaa can be any naturally occurring amino acid
  VARIANT (946)..(946): Xaa can be any naturally occurring amino acid except Pro or Gly
  VARIANT (948)..(948): Xaa can be any naturally occurring amino acid
  VARIANT (949)..(949): Xaa can be any naturally occurring amino acid
  VARIANT (950)..(950): Xaa can be any naturally occurring amino acid
  VARIANT (952)..(952): Xaa can be any naturally occurring amino acid except Pro or Gly
  VARIANT (954)..(954): Xaa can be any naturally occurring amino acid
  VARIANT (955)..(955): Xaa can be any naturally occurring amino acid
  VARIANT (956)..(956): Xaa can be any naturally occurring amino acid
  VARIANT (958)..(958): Xaa can be any naturally occurring amino acid except Pro or Gly
  VARIANT (960)..(960): Xaa can be any naturally occurring amino acid
XXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGX

SEQ ID NO: 150 - protein, 1120 aa, Artificial Sequence
  elastin-like polypeptide
  VARIANT (1)..(1): Xaa can be any naturally occurring amino acid
  VARIANT (2)..(2): Xaa can be any naturally occurring amino acid
  VARIANT (4)..(4): Xaa can be any naturally occurring amino acid except Pro or Gly
  VARIANT (5)..(5): Xaa can be any naturally occurring amino acid except Pro or Gly
  VARIANT (7)..(7): Xaa can be any naturally occurring amino acid
  VARIANT (8)..(8): Xaa can be any naturally occurring amino acid
  VARIANT (9)..(9): Xaa can be any naturally occurring amino acid
  VARIANT (11)..(11): Xaa can be any naturally occurring amino acid except Pro or Gly
  VARIANT (12)..(12): Xaa can be any naturally occurring amino acid except Pro or Gly
  VARIANT (14)..(14): Xaa can be any naturally occurring amino acid
  VARIANT (15)..(15): Xaa can be any naturally occurring amino acid
  VARIANT (16)..(16): Xaa can be any naturally occurring amino acid
  VARIANT (18)..(18): Xaa can be any naturally occurring amino acid except Pro or Gly
  VARIANT (19)..(19): Xaa can be any naturally occurring amino acid except Pro or Gly
  VARIANT (21)..(21): Xaa can be any naturally occurring amino acid
  VARIANT (22)..(22): Xaa can be any naturally occurring amino acid
  VARIANT (23)..(23): Xaa can be any naturally occurring amino acid
  VARIANT (25)..(25): Xaa can be any naturally occurring amino acid except Pro or Gly
  VARIANT (26)..(26): Xaa can be any naturally occurring amino acid except Pro or Gly
  VARIANT (28)..(28): Xaa can be any naturally occurring amino acid
  VARIANT (29)..(29): Xaa can be any naturally occurring amino acid
  VARIANT (30)..(30): Xaa can be any naturally occurring amino acid
  VARIANT (32)..(32): Xaa can be any naturally occurring amino acid except Pro or Gly
  VARIANT (33)..(33): Xaa can be any naturally occurring amino acid except Pro or Gly
  VARIANT (35)..(35): Xaa can be any naturally occurring amino acid
  VARIANT (36)..(36): Xaa can be any naturally occurring amino acid
  VARIANT (37)..(37): Xaa can be any naturally occurring amino acid
  VARIANT (39)..(39): Xaa can be any naturally occurring amino acid except Pro or Gly
  VARIANT (40)..(40): Xaa can be any naturally occurring amino acid except Pro or Gly
  VARIANT (42)..(42): Xaa can be any naturally occurring amino acid
  VARIANT (43)..(43): Xaa can be any naturally occurring amino acid
  VARIANT (44)..(44): Xaa can be any naturally occurring amino acid
  VARIANT (46)..(46): Xaa can be any naturally occurring amino acid except Pro or Gly
  VARIANT (47)..(47): Xaa can be any naturally occurring amino acid except Pro or Gly
  VARIANT (49)..(49): Xaa can be any naturally occurring amino acid
  VARIANT (50)..(50): Xaa can be any naturally occurring amino acid
  VARIANT (51)..(51): Xaa can be any naturally occurring amino acid
  VARIANT (53)..(53): Xaa can be any naturally occurring amino acid except Pro or Gly
  VARIANT (54)..(54): Xaa can be any naturally occurring amino acid except Pro or Gly
  VARIANT (56)..(56): Xaa can be any naturally occurring amino acid
  VARIANT (57)..(57): Xaa can be any naturally occurring amino acid
  VARIANT (58)..(58): Xaa can be any naturally occurring amino acid
  VARIANT (60)..(60): Xaa can be any naturally occurring amino acid except Pro or Gly
  VARIANT (61)..(61): Xaa can be any naturally occurring amino acid except Pro or Gly
  VARIANT (63)..(63): Xaa can be any naturally occurring amino acid
  VARIANT (64)..(64): Xaa can be any naturally occurring amino acid
  VARIANT (65)..(65): Xaa can be any naturally occurring amino acid
  VARIANT (67)..(67): Xaa can be any naturally occurring amino acid except Pro or Gly
  VARIANT (68)..(68): Xaa can be any naturally occurring amino acid except Pro or Gly
  VARIANT (70)..(70): Xaa can be any naturally occurring amino acid
  VARIANT (71)..(1120): May be present or absent in groups of the repeat unit Xaa Xaa Pro Xaa Xaa Gly Xaa
  VARIANT (71)..(71): Xaa can be any naturally occurring amino acid
  VARIANT (72)..(72): Xaa can be any naturally occurring amino acid
  VARIANT (74)..(74): Xaa can be any naturally occurring amino acid except Pro or Gly
  VARIANT (75)..(75): Xaa can be any naturally occurring amino acid except Pro or Gly
  VARIANT (77)..(77): Xaa can be any naturally occurring amino acid
  VARIANT (78)..(78): Xaa can be any naturally occurring amino acid
  VARIANT (79)..(79): Xaa can be any naturally occurring amino acid
  VARIANT (81)..(81): Xaa can be any naturally occurring amino acid except Pro or Gly
  VARIANT (82)..(82): Xaa can be any naturally occurring amino acid except Pro or Gly
  VARIANT (84)..(84): Xaa can be any naturally occurring amino acid
  VARIANT (85)..(85): Xaa can be any naturally occurring amino acid
  VARIANT (86)..(86): Xaa can be any naturally occurring amino acid
  VARIANT (88)..(88): Xaa can be any naturally occurring amino acid except Pro or Gly
  VARIANT (89)..(89): Xaa can be any naturally occurring amino acid except Pro or Gly
  VARIANT (91)..(91): Xaa can be any naturally occurring amino acid
  VARIANT (92)..(92): Xaa can be any naturally occurring amino acid
  VARIANT (93)..(93): Xaa can be any naturally occurring amino acid
  VARIANT (95)..(95): Xaa can be any naturally occurring amino acid except Pro or Gly
  VARIANT (96)..(96): Xaa can be any naturally occurring amino acid except Pro or Gly
  VARIANT (98)..(98): Xaa can be any naturally occurring amino acid
  VARIANT (99)..(99): Xaa can be any naturally occurring amino acid
  VARIANT (100)..(100): Xaa can be any naturally occurring amino acid
  VARIANT (102)..(102): Xaa can be any naturally occurring amino acid except Pro or Gly
  VARIANT (103)..(103): Xaa can be any naturally occurring amino acid except Pro or Gly
  VARIANT (105)..(105): Xaa can be any naturally occurring amino acid
  VARIANT (106)..(106): Xaa can be any naturally occurring amino acid
  VARIANT (107)..(107): Xaa can be any naturally occurring amino acid
  VARIANT (109)..(109): Xaa can be any naturally occurring amino acid except Pro or Gly
  VARIANT (110)..(110): Xaa can be any naturally occurring amino acid except Pro or Gly
  VARIANT (112)..(112): Xaa can be any naturally occurring amino acid
  VARIANT (113)..(113): Xaa can be any naturally occurring amino acid
  VARIANT (114)..(114): Xaa can be any naturally occurring amino acid
  VARIANT (116)..(116): Xaa can be any naturally occurring amino acid except Pro or Gly
  VARIANT (117)..(117): Xaa can be any naturally occurring amino acid except Pro or Gly
  VARIANT (119)..(119): Xaa can be any naturally occurring amino acid
  VARIANT (120)..(120): Xaa can be any naturally occurring amino acid
  VARIANT (121)..(121): Xaa can be any naturally occurring amino acid
  VARIANT (123)..(123): Xaa can be any naturally occurring amino acid except Pro or Gly
  VARIANT (124)..(124): Xaa can be any naturally occurring amino acid except Pro or Gly
  VARIANT (126)..(126): Xaa can be any naturally occurring amino acid
  VARIANT (127)..(127): Xaa can be any naturally occurring amino acid
  VARIANT (128)..(128): Xaa can be any naturally occurring amino acid
  VARIANT (130)..(130): Xaa can be any naturally occurring amino acid except Pro or Gly
  VARIANT (131)..(131): Xaa can be any naturally occurring amino acid except Pro or Gly
  VARIANT (133)..(133): Xaa can be any naturally occurring amino acid
  VARIANT (134)..(134): Xaa can be any naturally occurring amino acid
  VARIANT (135)..(135): Xaa can be any naturally occurring amino acid
  VARIANT (137)..(137): Xaa can be any naturally occurring amino acid except Pro or Gly
  VARIANT (138)..(138): Xaa can be any naturally occurring amino acid except Pro or Gly
  VARIANT (140)..(140): Xaa can be any naturally occurring amino acid
  VARIANT (141)..(141): Xaa can be any naturally occurring amino acid
  VARIANT (142)..(142): Xaa can be any naturally occurring amino acid
  VARIANT (144)..(144): Xaa can be any naturally occurring amino acid except Pro or Gly
  VARIANT (145)..(145): Xaa can be any naturally occurring amino acid except Pro or Gly
  VARIANT (147)..(147): Xaa can be any naturally occurring amino acid
  VARIANT (148)..(148): Xaa can be any naturally occurring amino acid
  VARIANT (149)..(149): Xaa can be any naturally occurring amino acid
  VARIANT (151)..(151): Xaa can be any naturally occurring amino acid except Pro or Gly
  VARIANT (152)..(152): Xaa can be any naturally occurring amino acid except Pro or Gly
  VARIANT (154)..(154): Xaa can be any naturally occurring amino acid
  VARIANT (155)..(155): Xaa can be any naturally occurring amino acid
  VARIANT (156)..(156): Xaa can be any naturally occurring amino acid
  VARIANT (158)..(158): Xaa can be any naturally occurring amino acid except Pro or Gly
  VARIANT (159)..(159): Xaa can be any naturally occurring amino acid except Pro or Gly
  VARIANT (161)..(161): Xaa can be any naturally occurring amino acid
  VARIANT (162)..(162): Xaa can be any naturally occurring amino acid
  VARIANT (163)..(163): Xaa can be any naturally occurring amino acid
  VARIANT (165)..(165): Xaa can be any naturally occurring amino acid except Pro or Gly
  VARIANT (166)..(166): Xaa can be any naturally occurring amino acid except Pro or Gly
  VARIANT (168)..(168): Xaa can be any naturally occurring amino acid
  VARIANT (169)..(169): Xaa can be any naturally occurring amino acid
  VARIANT (170)..(170): Xaa can be any naturally occurring amino acid
  VARIANT (172)..(172): Xaa can be any naturally occurring amino acid except Pro or Gly
  VARIANT (173)..(173): Xaa can be any naturally occurring amino acid except Pro or Gly
  VARIANT (175)..(175): Xaa can be any naturally occurring amino acid
  VARIANT (176)..(176): Xaa can be any naturally occurring amino acid
  VARIANT (177)..(177): Xaa can be any naturally occurring amino acid
  VARIANT (179)..(179): Xaa can be any naturally occurring amino acid except Pro or Gly
  VARIANT (180)..(180): Xaa can be any naturally occurring amino acid except Pro or Gly
  VARIANT (182)..(182): Xaa can be any naturally occurring amino acid
  VARIANT (183)..(183): Xaa can be any naturally occurring amino acid
  VARIANT (184)..(184): Xaa can be any naturally occurring amino acid
  VARIANT (186)..(186): Xaa can be any naturally occurring amino acid except Pro or Gly
  VARIANT (187)..(187): Xaa can be any naturally occurring amino acid except Pro or Gly
  VARIANT (189)..(189): Xaa can be any naturally occurring amino acid
  VARIANT (190)..(190): Xaa can be any naturally occurring amino acid
  VARIANT (191)..(191): Xaa can be any naturally occurring amino acid
  VARIANT (193)..(193): Xaa can be any naturally occurring amino acid except Pro or Gly
  VARIANT (194)..(194): Xaa can be any naturally occurring amino acid except Pro or Gly
  VARIANT (196)..(196): Xaa can be any naturally occurring amino acid
  VARIANT (197)..(197): Xaa can be any naturally occurring amino acid
  VARIANT (198)..(198): Xaa can be any naturally occurring amino acid
  VARIANT (200)..(200): Xaa can be any naturally occurring amino acid except Pro or Gly
  VARIANT (201)..(201): Xaa can be any naturally occurring amino acid except Pro or Gly
  VARIANT (203)..(203): Xaa can be any naturally occurring amino acid
  VARIANT (204)..(204): Xaa can be any naturally occurring amino acid
  VARIANT (205)..(205): Xaa can be any naturally occurring amino acid
  VARIANT (207)..(207): Xaa can be any naturally occurring amino acid except Pro or Gly
  VARIANT (208)..(208): Xaa can be any naturally occurring amino acid except Pro or Gly
  VARIANT (210)..(210): Xaa can be any naturally occurring amino acid
  VARIANT (211)..(211): Xaa can be any naturally occurring amino acid
  VARIANT (212)..(212): Xaa can be any naturally occurring amino acid
  VARIANT (214)..(214): Xaa can be any naturally occurring amino acid except Pro or Gly
  VARIANT (215)..(215): Xaa can be any naturally occurring amino acid except Pro or Gly
  VARIANT (217)..(217): Xaa can be any naturally occurring amino acid
  VARIANT (218)..(218): Xaa can be any naturally occurring amino acid
  VARIANT (219)..(219): Xaa can be any naturally occurring amino acid
  VARIANT (221)..(221): Xaa can be any naturally occurring amino acid except Pro or Gly
  VARIANT (222)..(222): Xaa can be any naturally occurring amino acid except Pro or Gly
  VARIANT (224)..(224): Xaa can be any naturally occurring amino acid
  VARIANT (225)..(225): Xaa can be any naturally occurring amino acid
  VARIANT (226)..(226): Xaa can be any naturally occurring amino acid
  VARIANT (228)..(228): Xaa can be any naturally occurring amino acid except Pro or Gly
  VARIANT (229)..(229): Xaa can be any naturally occurring amino acid except Pro or Gly
  VARIANT (231)..(231): Xaa can be any naturally occurring amino acid
  VARIANT (232)..(232): Xaa can be any naturally occurring amino acid
  VARIANT (233)..(233): Xaa can be any naturally occurring amino acid
  VARIANT (235)..(235): Xaa can be any naturally occurring amino acid except Pro or Gly
  VARIANT (236)..(236): Xaa can be any naturally occurring amino acid except Pro or Gly
  VARIANT (238)..(238): Xaa can be any naturally occurring amino acid
  VARIANT (239)..(239): Xaa can be any naturally occurring amino acid
  VARIANT (240)..(240): Xaa can be any naturally occurring amino acid
  VARIANT (242)..(242): Xaa can be any naturally occurring amino acid except Pro or Gly
  VARIANT (243)..(243): Xaa can be any naturally occurring amino acid except Pro or Gly
  VARIANT (245)..(245): Xaa can be any naturally occurring amino acid
  VARIANT (246)..(246): Xaa can be any naturally occurring amino acid
  VARIANT (247)..(247): Xaa can be any naturally occurring amino acid
  VARIANT (249)..(249): Xaa can be any naturally occurring amino acid except Pro or Gly
  VARIANT (250)..(250): Xaa can be any naturally occurring amino acid except Pro or Gly
  VARIANT (252)..(252): Xaa can be any naturally occurring amino acid
  VARIANT (253)..(253): Xaa can be any naturally occurring amino acid
  VARIANT (254)..(254): Xaa can be any naturally occurring amino acid
  VARIANT (256)..(256): Xaa can be any naturally occurring amino acid except Pro or Gly
  VARIANT (257)..(257): Xaa can be any naturally occurring amino acid except Pro or Gly
  VARIANT (259)..(259): Xaa can be any naturally occurring amino acid
  VARIANT (260)..(260): Xaa can be any naturally occurring amino acid
  VARIANT (261)..(261): Xaa can be any naturally occurring amino acid
  VARIANT (263)..(263): Xaa can be any naturally occurring amino acid except Pro or Gly
  VARIANT (264)..(264): Xaa can be any naturally occurring amino acid except Pro or Gly
  VARIANT (266)..(266): Xaa can be any naturally occurring amino acid
  VARIANT (267)..(267): Xaa can be any naturally occurring amino acid
  VARIANT (268)..(268): Xaa can be any naturally occurring amino acid
  VARIANT (270)..(270): Xaa can be any naturally occurring amino acid except Pro or Gly
  VARIANT (271)..(271): Xaa can be any naturally occurring amino acid except Pro or Gly
  VARIANT (273)..(273): Xaa can be any naturally occurring amino acid
  VARIANT (274)..(274): Xaa can be any naturally occurring amino acid
  VARIANT (275)..(275): Xaa can be any naturally occurring amino acid
  VARIANT (277)..(277): Xaa can be any naturally occurring amino acid except Pro or Gly
  VARIANT (278)..(278): Xaa can be any naturally occurring amino acid except Pro or Gly
  VARIANT (280)..(280): Xaa can be any naturally occurring amino acid
  VARIANT (281)..(281): Xaa can be any naturally occurring amino acid
  VARIANT (282)..(282): Xaa can be any naturally occurring amino acid
  VARIANT (284)..(284): Xaa can be any naturally occurring amino acid except Pro or Gly
  VARIANT (285)..(285): Xaa can be any naturally occurring amino acid except Pro or Gly
  VARIANT (287)..(287): Xaa can be any naturally occurring amino acid
  VARIANT (288)..(288): Xaa can be any naturally occurring amino acid
  VARIANT (289)..(289): Xaa can be any naturally occurring amino acid
  VARIANT (291)..(291): Xaa can be any naturally occurring amino acid except Pro or Gly
  VARIANT (292)..(292): Xaa can be any naturally occurring amino acid except Pro or Gly
  VARIANT (294)..(294): Xaa can be any naturally occurring amino acid
  VARIANT (295)..(295): Xaa can be any naturally occurring amino acid
  VARIANT (296)..(296): Xaa can be any naturally occurring amino acid
  VARIANT (298)..(298): Xaa can be any naturally occurring amino acid except Pro or Gly
  VARIANT (299)..(299): Xaa can be any naturally occurring amino acid except Pro or Gly
  VARIANT (301)..(301): Xaa can be any naturally occurring amino acid
  VARIANT (302)..(302): Xaa can be any naturally occurring amino acid
  VARIANT (303)..(303): Xaa can be any naturally occurring amino acid
  VARIANT (305)..(305): Xaa can be any naturally occurring amino acid except Pro or Gly
  VARIANT (306)..(306): Xaa can be any naturally occurring amino acid except Pro or Gly
  VARIANT (308)..(308): Xaa can be any naturally occurring amino acid
  VARIANT (309)..(309): Xaa can be any naturally occurring amino acid
  VARIANT (310)..(310): Xaa can be any naturally occurring amino acid
  VARIANT (312)..(312): Xaa can be any naturally occurring amino acid except Pro or Gly
  VARIANT (313)..(313): Xaa can be any naturally occurring amino acid except Pro or Gly
  VARIANT (315)..(315): Xaa can be any naturally occurring amino acid
  VARIANT (316)..(316): Xaa can be any naturally occurring amino acid
  VARIANT (317)..(317): Xaa can be any naturally occurring amino acid
  VARIANT (319)..(319): Xaa can be any naturally occurring amino acid except Pro or Gly
  VARIANT (320)..(320): Xaa can be any naturally occurring amino acid except Pro or Gly
  VARIANT (322)..(322): Xaa can be any naturally occurring amino acid
  VARIANT (323)..(323): Xaa can be any naturally occurring amino acid
  VARIANT (324)..(324): Xaa can be any naturally occurring amino acid
  VARIANT (326)..(326): Xaa can be any naturally occurring amino acid except Pro or Gly
  VARIANT (327)..(327): Xaa can be any naturally occurring amino acid except Pro or Gly
  VARIANT (329)..(329): Xaa can be any naturally occurring amino acid
  VARIANT (330)..(330): Xaa can be any naturally occurring amino acid
  VARIANT (331)..(331): Xaa can be any naturally occurring amino acid
  VARIANT (333)..(333): Xaa can be any naturally occurring amino acid except Pro or Gly
  VARIANT (334)..(334): Xaa can be any naturally occurring amino acid except Pro or Gly
  VARIANT (336)..(336): Xaa can be any naturally occurring amino acid
  VARIANT (337)..(337): Xaa can be any naturally occurring amino acid
  VARIANT (338)..(338): Xaa can be any naturally occurring amino acid
  VARIANT (340)..(340): Xaa can be any naturally occurring amino acid except Pro or Gly
  VARIANT (341)..(341): Xaa can be any naturally occurring amino acid except Pro or Gly
  VARIANT (343)..(343): Xaa can be any naturally occurring amino acid
  VARIANT (344)..(344): Xaa can be any naturally occurring amino acid
  VARIANT (345)..(345): Xaa can be any naturally occurring amino acid
  VARIANT (347)..(347): Xaa can be any naturally occurring amino acid except Pro or Gly
  VARIANT (348)..(348): Xaa can be any naturally occurring amino acid except Pro or Gly
  VARIANT (350)..(350): Xaa can be any naturally occurring amino acid
  VARIANT (351)..(351): Xaa can be any naturally occurring amino acid
  VARIANT (352)..(352): Xaa can be any naturally occurring amino acid
  VARIANT (354)..(354): Xaa can be any naturally occurring amino acid except Pro or Gly
  VARIANT (355)..(355): Xaa can be any naturally occurring amino acid except Pro or Gly
  VARIANT (357)..(357): Xaa can be any naturally occurring amino acid
  VARIANT (358)..(358): Xaa can be any naturally occurring amino acid
  VARIANT (359)..(359): Xaa can be any naturally occurring amino acid
  VARIANT (361)..(361): Xaa can be any naturally occurring amino acid except Pro or Gly
  VARIANT (362)..(362): Xaa can be any naturally occurring amino acid except Pro or Gly
  VARIANT (364)..(364): Xaa can be any naturally occurring amino acid
  VARIANT (365)..(365): Xaa can be any naturally occurring amino acid
  VARIANT (366)..(366): Xaa can be any naturally occurring amino acid
  VARIANT (368)..(368): Xaa can be any naturally occurring amino acid except Pro or Gly
  VARIANT (369)..(369): Xaa can be any naturally occurring amino acid except Pro or Gly
  VARIANT (371)..(371): Xaa can be any naturally occurring amino acid
  VARIANT (372)..(372): Xaa can be any naturally occurring amino acid
  VARIANT (373)..(373): Xaa can be any naturally occurring amino acid
  VARIANT (375)..(375): Xaa can be any naturally occurring amino acid except Pro or Gly
  VARIANT (376)..(376): Xaa can be any naturally occurring amino acid except Pro or Gly
  VARIANT (378)..(378): Xaa can be any naturally occurring amino acid
  VARIANT (379)..(379): Xaa can be any naturally occurring amino acid
  VARIANT (380)..(380): Xaa can be any naturally occurring amino acid
  VARIANT (382)..(382): Xaa can be any naturally occurring amino acid except Pro or Gly
  VARIANT (383)..(383): Xaa can be any naturally occurring amino acid except Pro or Gly
  VARIANT (385)..(385): Xaa can be any naturally occurring amino acid
  VARIANT (386)..(386): Xaa can be any naturally occurring amino acid
  VARIANT (387)..(387): Xaa can be any naturally occurring amino acid
  VARIANT (389)..(389): Xaa can be any naturally occurring amino acid except Pro or Gly
  VARIANT (390)..(390): Xaa can be any naturally occurring amino acid except Pro or Gly
  VARIANT (392)..(392): Xaa can be any naturally occurring amino acid
  VARIANT (393)..(393): Xaa can be any naturally occurring amino acid
  VARIANT (394)..(394): Xaa can be any naturally occurring amino acid
  VARIANT (396)..(396): Xaa can be any naturally occurring amino acid except Pro or Gly
  VARIANT (397)..(397): Xaa can be any naturally occurring amino acid except Pro or Gly
  VARIANT (399)..(399): Xaa can be any naturally occurring amino acid
  VARIANT (400)..(400): Xaa can be any naturally occurring amino acid
  VARIANT (401)..(401): Xaa can be any naturally occurring amino acid
  VARIANT (403)..(403): Xaa can be any naturally occurring amino acid except Pro or Gly
  VARIANT (404)..(404): Xaa can be any naturally occurring amino acid except Pro or Gly
  VARIANT (406)..(406): Xaa can be any naturally occurring amino acid
  VARIANT (407)..(407): Xaa can be any naturally occurring amino acid
  VARIANT (408)..(408): Xaa can be any naturally occurring amino acid
  VARIANT (410)..(410): Xaa can be any naturally occurring amino acid except Pro or Gly
  VARIANT (411)..(411): Xaa can be any naturally occurring amino acid except Pro or Gly
  VARIANT (413)..(413): Xaa can be any naturally occurring amino acid
  VARIANT (414)..(414): Xaa can be any naturally occurring amino acid
  VARIANT (415)..(415): Xaa can be any naturally occurring amino acid
  VARIANT (417)..(417): Xaa can be any naturally occurring amino acid except Pro or Gly
  VARIANT (418)..(418): Xaa can be any naturally occurring amino acid except Pro or Gly
  VARIANT (420)..(420): Xaa can be any naturally occurring amino acid
  VARIANT (421)..(421): Xaa can be any naturally occurring amino acid
  VARIANT (422)..(422): Xaa can be any naturally occurring amino acid
  VARIANT (424)..(424): Xaa can be any naturally occurring amino acid except Pro or Gly
  VARIANT (425)..(425): Xaa can be any naturally occurring amino acid except Pro or Gly
  VARIANT (427)..(427): Xaa can be any naturally occurring amino acid
  VARIANT (428)..(428): Xaa can be any naturally occurring amino acid
  VARIANT (429)..(429): Xaa can be any naturally occurring amino acid
  VARIANT (431)..(431): Xaa can be any naturally occurring amino acid except Pro or Gly
  VARIANT (432)..(432): Xaa can be any naturally occurring amino acid except Pro or Gly
  VARIANT (434)..(434): Xaa can be any naturally occurring amino acid
  VARIANT (435)..(435): Xaa can be any naturally occurring amino acid
  VARIANT (436)..(436): Xaa can be any naturally occurring amino acid
  VARIANT (438)..(438): Xaa can be any naturally occurring amino acid except Pro or Gly
  VARIANT (439)..(439): Xaa can be any naturally occurring amino acid except Pro or Gly
  VARIANT (441)..(441): Xaa can be any naturally occurring amino acid
  VARIANT (442)..(442): Xaa can be any naturally occurring amino acid
  VARIANT (443)..(443): Xaa can be any naturally occurring amino acid
  VARIANT (445)..(445): Xaa can be any naturally occurring amino acid except Pro or Gly
  VARIANT (446)..(446): Xaa can be any naturally occurring amino acid except Pro or Gly
  VARIANT (448)..(448): Xaa can be any naturally occurring amino acid
  VARIANT (449)..(449): Xaa can be any naturally occurring amino acid
  VARIANT (450)..(450): Xaa can be any naturally occurring amino acid
  VARIANT (452)..(452): Xaa can be any naturally occurring amino acid except Pro or Gly
  VARIANT (453)..(453): Xaa can be any naturally occurring amino acid except Pro or Gly
  VARIANT (455)..(455): Xaa can be any naturally occurring amino acid
  VARIANT (456)..(456): Xaa can be any naturally occurring amino acid
  VARIANT (457)..(457): Xaa can be any naturally occurring amino acid
  VARIANT (459)..(459): Xaa can be any naturally occurring amino acid except Pro or Gly
  VARIANT (460)..(460): Xaa can be any naturally occurring amino acid except Pro or Gly
  VARIANT (462)..(462): Xaa can be any naturally occurring amino acid
  VARIANT (463)..(463): Xaa can be any naturally occurring amino acid
  VARIANT (464)..(464): Xaa can be any naturally occurring amino acid
  VARIANT (466)..(466): Xaa can be any naturally occurring amino acid except Pro or Gly
  VARIANT (467)..(467): Xaa can be any naturally occurring amino acid except Pro or Gly
  VARIANT (469)..(469): Xaa can be any naturally occurring amino acid
  VARIANT (470)..(470): Xaa can be any naturally occurring amino acid
  VARIANT (471)..(471): Xaa can be any naturally occurring amino acid
  VARIANT (473)..(473): Xaa can be any naturally occurring amino acid except Pro or Gly
  VARIANT (474)..(474): Xaa can be any naturally occurring amino acid except Pro or Gly
  VARIANT (476)..(476): Xaa can be any naturally occurring amino acid
  VARIANT (477)..(477): Xaa can be any naturally occurring amino acid
  VARIANT (478)..(478): Xaa can be any naturally occurring amino acid
  VARIANT (480)..(480): Xaa can be any naturally occurring amino acid except Pro or Gly
  VARIANT (481)..(481): Xaa can be any naturally occurring amino acid except Pro or Gly
  VARIANT (483)..(483): Xaa can be any naturally occurring amino acid
  VARIANT (484)..(484): Xaa can be any naturally occurring amino acid
  VARIANT (485)..(485): Xaa can be any naturally occurring amino acid
  VARIANT (487)..(487): Xaa can be any naturally occurring amino acid except Pro or Gly
  VARIANT (488)..(488): Xaa can be any naturally occurring amino acid except Pro or Gly
  VARIANT (490)..(490): Xaa can be any naturally occurring amino acid
  VARIANT (491)..(491): Xaa can be any naturally occurring amino acid
  VARIANT (492)..(492): Xaa can be any naturally occurring amino acid
  VARIANT (494)..(494): Xaa can be any naturally occurring amino acid except Pro or Gly
  VARIANT (495)..(495): Xaa can be any naturally occurring amino acid except Pro or Gly
  VARIANT (497)..(497): Xaa can be any naturally occurring amino acid
  VARIANT (498)..(498): Xaa can be any naturally occurring amino acid
  VARIANT (499)..(499): Xaa can be any naturally occurring amino acid
  VARIANT (501)..(501): Xaa can be any naturally occurring amino acid except Pro or Gly
  VARIANT (502)..(502): Xaa can be any naturally occurring amino acid except Pro or Gly
  VARIANT (504)..(504): Xaa can be any naturally occurring amino acid
  VARIANT (505)..(505): Xaa can be any naturally occurring amino acid
  VARIANT (506)..(506): Xaa can be any naturally occurring amino acid
  VARIANT (508)..(508): Xaa can be any naturally occurring amino acid except Pro or Gly
  VARIANT (509)..(509): Xaa can be any naturally occurring amino acid except Pro or Gly
  VARIANT (511)..(511): Xaa can be any naturally occurring amino acid
  VARIANT (512)..(512): Xaa can be any naturally occurring amino acid
  VARIANT (513)..(513): Xaa can be any naturally occurring amino acid
  VARIANT (515)..(515): Xaa can be any naturally occurring amino acid except Pro or Gly
  VARIANT (516)..(516): Xaa can be any naturally occurring amino acid except Pro or Gly
  VARIANT (518)..(518): Xaa can be any naturally occurring amino acid
  VARIANT (519)..(519): Xaa can be any naturally occurring amino acid
  VARIANT (520)..(520): Xaa can be any naturally occurring amino acid
  VARIANT (522)..(522): Xaa can be any naturally occurring amino acid except Pro or Gly
  VARIANT (523)..(523): Xaa can be any naturally occurring amino acid except Pro or Gly
  VARIANT (525)..(525): Xaa can be any naturally occurring amino acid
  VARIANT (526)..(526): Xaa can be any naturally occurring amino acid
  VARIANT (527)..(527): Xaa can be any naturally occurring amino acid
  VARIANT (529)..(529): Xaa can be any naturally occurring amino acid except Pro or Gly
  VARIANT (530)..(530): Xaa can be any naturally occurring amino acid except Pro or Gly
  VARIANT (532)..(532): Xaa can be any naturally occurring amino acid
  VARIANT (533)..(533): Xaa can be any naturally occurring amino acid
  VARIANT (534)..(534): Xaa can be any naturally occurring amino acid
  VARIANT (536)..(536): Xaa can be any naturally occurring amino acid except Pro or Gly
  VARIANT (537)..(537): Xaa can be any naturally occurring amino acid except Pro or Gly
  VARIANT (539)..(539): Xaa can be any naturally occurring amino acid
  VARIANT (540)..(540): Xaa can be any naturally occurring amino acid
  VARIANT (541)..(541): Xaa can be any naturally occurring amino acid
  VARIANT (543)..(543): Xaa can be any naturally occurring amino acid except Pro or Gly
  VARIANT (544)..(544): Xaa can be any naturally occurring amino acid except Pro or Gly
  VARIANT (546)..(546): Xaa can be any naturally occurring amino acid
  VARIANT (547)..(547): Xaa can be any naturally occurring amino acid
  VARIANT (548)..(548): Xaa can be any naturally occurring amino acid
  VARIANT (550)..(550): Xaa can be any naturally occurring amino acid except Pro or Gly
  VARIANT (551)..(551): Xaa can be any naturally occurring amino acid except Pro or Gly
  VARIANT (553)..(553): Xaa can be any naturally occurring amino acid
  VARIANT (554)..(554): Xaa can be any naturally occurring amino acid
  VARIANT (555)..(555): Xaa can be any naturally occurring amino acid
  VARIANT (557)..(557): Xaa can be any naturally occurring amino acid except Pro or Gly
  VARIANT (558)..(558): Xaa can be any naturally occurring amino acid except Pro or Gly
  VARIANT (560)..(560): Xaa can be any naturally occurring amino acid
  VARIANT (561)..(561): Xaa can be any naturally occurring amino acid
  VARIANT (562)..(562): Xaa can be any naturally occurring amino acid
  VARIANT (564)..(564): Xaa can be any naturally occurring amino acid except Pro or Gly
  VARIANT (565)..(565): Xaa can be any naturally occurring amino acid except Pro or Gly
  VARIANT (567)..(567): Xaa can be any naturally occurring amino acid
  VARIANT (568)..(568): Xaa can be any naturally occurring amino acid
  VARIANT (569)..(569): Xaa can be any naturally occurring amino acid
  VARIANT (571)..(571): Xaa can be any naturally occurring amino acid except Pro or Gly
  VARIANT (572)..(572): Xaa can be any naturally occurring amino acid except Pro or Gly
  VARIANT (574)..(574): Xaa can be any naturally occurring amino acid
  VARIANT (575)..(575): Xaa can be any naturally occurring amino acid
  VARIANT (576)..(576): Xaa can be any naturally occurring amino acid
  VARIANT (578)..(578): Xaa can be any naturally occurring amino acid except Pro or Gly
  VARIANT (579)..(579): Xaa can be any naturally occurring amino acid except Pro or Gly
  VARIANT (581)..(581): Xaa can be any naturally occurring amino acid
  VARIANT (582)..(582): Xaa can be any naturally occurring amino acid
  VARIANT (583)..(583): Xaa can be any naturally occurring amino acid
  VARIANT (585)..(585): Xaa can be any naturally occurring amino acid except Pro or Gly
  VARIANT (586)..(586): Xaa can be any naturally occurring amino acid except Pro or Gly
  VARIANT (588)..(588): Xaa can be any naturally occurring amino acid
  VARIANT (589)..(589): Xaa can be any naturally occurring amino acid
  VARIANT (590)..(590): Xaa can be any naturally occurring amino acid
  VARIANT (592)..(592): Xaa can be any naturally occurring amino acid except Pro or Gly
  VARIANT (593)..(593): Xaa can be any naturally occurring amino acid except Pro or Gly
  VARIANT (595)..(595): Xaa can be any naturally occurring amino acid
  VARIANT (596)..(596): Xaa can be any naturally occurring amino acid
  VARIANT (597)..(597): Xaa can be any naturally occurring amino acid
  VARIANT (599)..(599): Xaa can be any naturally occurring amino acid except Pro or Gly
  VARIANT (600)..(600): Xaa can be any naturally occurring amino acid except Pro or Gly
  VARIANT (602)..(602): Xaa can be any naturally occurring amino acid
  VARIANT (603)..(603): Xaa can be any naturally occurring amino acid
  VARIANT (604)..(604): Xaa can be any naturally occurring amino acid
  VARIANT (606)..(606): Xaa can be any naturally occurring amino acid except Pro or Gly
  VARIANT (607)..(607): Xaa can be any naturally occurring amino acid except Pro or Gly
  VARIANT (609)..(609): Xaa can be any naturally occurring amino acid
  VARIANT (610)..(610): Xaa can be any naturally occurring amino acid
  VARIANT (611)..(611): Xaa can be any naturally occurring amino acid
  VARIANT (613)..(613): Xaa can be any naturally occurring amino acid except Pro or Gly
  VARIANT (614)..(614): Xaa can be any naturally occurring amino acid except Pro or Gly
  VARIANT (616)..(616): Xaa can be any naturally occurring amino acid
  VARIANT (617)..(617): Xaa can be any naturally occurring amino acid
  VARIANT (618)..(618): Xaa can be any naturally occurring amino acid
  VARIANT (620)..(620): Xaa can be any naturally occurring amino acid except Pro or Gly
  VARIANT (621)..(621): Xaa can be any naturally occurring amino acid except Pro or Gly
  VARIANT (623)..(623): Xaa can be any naturally occurring amino acid
  VARIANT (624)..(624): Xaa can be any naturally occurring amino acid
  VARIANT (625)..(625): Xaa can be any naturally occurring amino acid
  VARIANT (627)..(627): Xaa can be any naturally occurring amino acid except Pro or Gly
  VARIANT (628)..(628): Xaa can be any naturally occurring amino acid except Pro or Gly
  VARIANT (630)..(630): Xaa can be any naturally occurring amino acid
  VARIANT (631)..(631): Xaa can be any naturally occurring amino acid
  VARIANT (632)..(632): Xaa can be any naturally occurring amino acid
  VARIANT (634)..(634): Xaa can be any naturally occurring amino acid except Pro or Gly
  VARIANT (635)..(635): Xaa can be any naturally occurring amino acid except Pro or Gly
  VARIANT (637)..(637): Xaa can be any naturally occurring amino acid
  VARIANT (638)..(638): Xaa can be any naturally occurring amino acid
  VARIANT (639)..(639): Xaa can be any naturally occurring amino acid
  VARIANT (641)..(641): Xaa can be any naturally occurring amino acid except Pro or Gly
  VARIANT (642)..(642): Xaa can be any naturally occurring amino acid except Pro or Gly
  VARIANT (644)..(644): Xaa can be any naturally occurring amino acid
  VARIANT (645)..(645): Xaa can be any naturally occurring amino acid
  VARIANT (646)..(646): Xaa can be any naturally occurring amino acid
  VARIANT (648)..(648): Xaa can be any naturally occurring amino acid except Pro or Gly
  VARIANT (649)..(649): Xaa can be any naturally occurring amino acid except Pro or Gly
  VARIANT (651)..(651): Xaa can be any naturally occurring amino acid
  VARIANT (652)..(652): Xaa can be any naturally occurring amino acid
  VARIANT (653)..(653): Xaa can be any naturally occurring amino acid
  VARIANT (655)..(655): Xaa can be any naturally occurring amino acid except Pro or Gly
  VARIANT (656)..(656): Xaa can be any naturally occurring amino acid except Pro or Gly
  VARIANT (658)..(658): Xaa can be any naturally occurring amino acid
  VARIANT (659)..(659): Xaa can be any naturally occurring amino acid
  VARIANT (660)..(660): Xaa can be any naturally occurring amino acid
  VARIANT (662)..(662): Xaa can be any naturally occurring amino acid except Pro or Gly
  VARIANT (663)..(663): Xaa can be any naturally occurring amino acid except Pro or Gly
  VARIANT (665)..(665): Xaa can be any naturally occurring amino acid
  VARIANT (666)..(666): Xaa can be any naturally occurring amino acid
  VARIANT (667)..(667): Xaa can be any naturally occurring amino acid
  VARIANT (669)..(669): Xaa can be any naturally occurring amino acid except Pro or Gly
  VARIANT (670)..(670): Xaa can be any naturally occurring amino acid except Pro or Gly
  VARIANT (672)..(672): Xaa can be any naturally occurring amino acid
  VARIANT (673)..(673): Xaa can be any naturally occurring amino acid
  VARIANT (674)..(674): Xaa can be any naturally occurring amino acid
  VARIANT (676)..(676): Xaa can be any naturally occurring amino acid except Pro or Gly
  VARIANT (677)..(677): Xaa can be any naturally occurring amino acid except Pro or Gly
  VARIANT (679)..(679): Xaa can be any naturally occurring amino acid
  VARIANT (680)..(680): Xaa can be any naturally occurring amino acid
  VARIANT (681)..(681): Xaa can be any naturally occurring amino acid
  VARIANT (683)..(683): Xaa can be any naturally occurring amino acid except Pro or Gly
  VARIANT (684)..(684): Xaa can be any naturally occurring amino acid except Pro or Gly
  VARIANT (686)..(686): Xaa can be any naturally occurring amino acid
  VARIANT (687)..(687): Xaa can be any naturally occurring amino acid
  VARIANT (688)..(688): Xaa can be any naturally occurring amino acid
  VARIANT (690)..(690): Xaa can be any naturally occurring amino acid except Pro or Gly
  VARIANT (691)..(691): Xaa can be any naturally occurring amino acid except Pro or Gly
  VARIANT (693)..(693): Xaa can be any naturally occurring amino acid
  VARIANT (694)..(694): Xaa can be any naturally occurring amino acid
  VARIANT (695)..(695): Xaa can be any naturally occurring amino acid
  VARIANT (697)..(697): Xaa can be any naturally occurring amino acid except Pro or Gly
  VARIANT (698)..(698): Xaa can be any naturally occurring amino acid except Pro or Gly
  VARIANT (700)..(700): Xaa can be any naturally occurring amino acid
  VARIANT (701)..(701): Xaa can be any naturally occurring amino acid
  VARIANT (702)..(702): Xaa can be any naturally occurring amino acid
  VARIANT (704)..(704): Xaa can be any naturally occurring amino acid except Pro or Gly
  VARIANT (705)..(705): Xaa can be any naturally occurring amino acid except Pro or Gly
  VARIANT (707)..(707): Xaa can be any naturally occurring amino acid
  VARIANT (708)..(708): Xaa can be any naturally occurring amino acid
  VARIANT (709)..(709): Xaa can be any naturally occurring amino acid
  VARIANT (711)..(711): Xaa can be any naturally occurring amino acid except Pro or Gly
  VARIANT (712)..(712): Xaa can be any naturally occurring amino acid except Pro or Gly
  VARIANT (714)..(714): Xaa can be any naturally occurring amino acid
  VARIANT (715)..(715): Xaa can be any naturally occurring amino acid
  VARIANT (716)..(716): Xaa can be any naturally occurring amino acid
  VARIANT (718)..(718): Xaa can be any naturally occurring amino acid except Pro or Gly
  VARIANT (719)..(719): Xaa can be any naturally occurring amino acid except Pro or Gly
  VARIANT (721)..(721): Xaa can be any naturally occurring amino acid
  VARIANT (722)..(722): Xaa can be any naturally occurring amino acid
  VARIANT (723)..(723): Xaa can be any naturally occurring amino acid
  VARIANT (725)..(725): Xaa can be any naturally occurring amino acid except Pro or Gly
  VARIANT (726)..(726): Xaa can be any naturally occurring amino acid except Pro or Gly
  VARIANT (728)..(728): Xaa can be any naturally occurring amino acid
  VARIANT (729)..(729): Xaa can be any naturally occurring amino acid
  VARIANT (730)..(730): Xaa can be any naturally occurring amino acid
  VARIANT (732)..(732): Xaa can be any naturally occurring amino acid except Pro or Gly
  VARIANT (733)..(733): Xaa can be any naturally occurring amino acid except Pro or Gly
  VARIANT (735)..(735): Xaa can be any naturally occurring amino acid
  VARIANT (736)..(736): Xaa can be any naturally occurring amino acid
  VARIANT (737)..(737): Xaa can be any naturally occurring amino acid
  VARIANT (739)..(739): Xaa can be any naturally occurring amino acid except Pro or Gly
  VARIANT (740)..(740): Xaa can be any naturally occurring amino acid except Pro or Gly
  VARIANT (742)..(742): Xaa can be any naturally occurring amino acid
  VARIANT (743)..(743): Xaa can be any naturally occurring amino acid
  VARIANT (744)..(744): Xaa can be any naturally occurring amino acid
  VARIANT (746)..(746): Xaa can be any naturally occurring amino acid except Pro or Gly
  VARIANT (747)..(747): Xaa can be any naturally occurring amino acid except Pro or Gly
  VARIANT (749)..(749): Xaa can be any naturally occurring amino acid
  VARIANT (750)..(750): Xaa can be any naturally occurring amino acid
  VARIANT (751)..(751): Xaa can be any naturally occurring amino acid
  VARIANT (753)..(753): Xaa can be any naturally occurring amino acid except Pro or Gly
  VARIANT (754)..(754): Xaa can be any naturally occurring amino acid except Pro or Gly
  VARIANT (756)..(756): Xaa can be any naturally occurring amino acid
  VARIANT (757)..(757): Xaa can be any naturally occurring amino acid
  VARIANT (758)..(758): Xaa can be any naturally occurring amino acid
  VARIANT (760)..(760): Xaa can be any naturally occurring amino acid except Pro or Gly
  VARIANT (761)..(761): Xaa can be any naturally occurring amino acid except Pro or Gly
  VARIANT (763)..(763): Xaa can be any naturally occurring amino acid
  VARIANT (764)..(764): Xaa can be any naturally occurring amino acid
  VARIANT (765)..(765): Xaa can be any naturally occurring amino acid
  VARIANT (767)..(767): Xaa can be any naturally occurring amino acid except Pro or Gly
  VARIANT (768)..(768): Xaa can be any naturally occurring amino acid except Pro or Gly
  VARIANT (770)..(770): Xaa can be any naturally occurring amino acid
  VARIANT (771)..(771): Xaa can be any naturally occurring amino acid
  VARIANT (772)..(772): Xaa can be any naturally occurring amino acid
  VARIANT (774)..(774): Xaa can be any naturally occurring amino acid except Pro or Gly
  VARIANT (775)..(775): Xaa can be any naturally occurring amino acid except Pro or Gly
  VARIANT (777)..(777): Xaa can be any naturally occurring amino acid
  VARIANT (778)..(778): Xaa can be any naturally occurring amino acid
  VARIANT (779)..(779): Xaa can be any naturally occurring amino acid
  VARIANT (781)..(781): Xaa can be any naturally occurring amino acid except Pro or Gly
  VARIANT (782)..(782): Xaa can be any naturally occurring amino acid except Pro or Gly
  VARIANT (784)..(784): Xaa can be any naturally occurring amino acid
  VARIANT (785)..(785): Xaa can be any naturally occurring amino acid
  VARIANT (786)..(786): Xaa can be any naturally occurring amino acid
  VARIANT (788)..(788): Xaa can be any naturally occurring amino acid except Pro or Gly
  VARIANT (789)..(789): Xaa can be any naturally occurring amino acid except Pro or Gly
  VARIANT (791)..(791): Xaa can be any naturally occurring amino acid
  VARIANT (792)..(792): Xaa can be any naturally occurring amino acid
  VARIANT (793)..(793): Xaa can be any naturally occurring amino acid
  VARIANT (795)..(795): Xaa can be any naturally occurring amino acid except Pro or Gly
  VARIANT (796)..(796): Xaa can be any naturally occurring amino acid except Pro or Gly
  VARIANT (798)..(798): Xaa can be any naturally occurring amino acid
  VARIANT (799)..(799): Xaa can be any naturally occurring amino acid
  VARIANT (800)..(800): Xaa can be any naturally occurring amino acid
  VARIANT (802)..(802): Xaa can be any naturally occurring amino acid except Pro or Gly
  VARIANT (803)..(803): Xaa can be any naturally occurring amino acid except Pro or Gly
  VARIANT (805)..(805): Xaa can be any naturally occurring amino acid
  VARIANT (806)..(806): Xaa can be any naturally occurring amino acid
  VARIANT (807)..(807): Xaa can be any naturally occurring amino acid
  VARIANT (809)..(809): Xaa can be any naturally occurring amino acid except Pro or Gly
  VARIANT (810)..(810): Xaa can be any naturally occurring amino acid except Pro or Gly
  VARIANT (812)..(812): Xaa can be any naturally occurring amino acid
  VARIANT (813)..(813): Xaa can be any naturally occurring amino acid
  VARIANT (814)..(814): Xaa can be any naturally occurring amino acid
  VARIANT (816)..(816): Xaa can be any naturally occurring amino acid except Pro or Gly
  VARIANT (817)..(817): Xaa can be any naturally occurring amino acid except Pro or Gly
  VARIANT (819)..(819): Xaa can be any naturally occurring amino acid
  VARIANT (820)..(820): Xaa can be any naturally occurring amino acid
  VARIANT (821)..(821): Xaa can be any naturally occurring amino acid
  VARIANT (823)..(823): Xaa can be any naturally occurring amino acid except Pro or Gly
  VARIANT (824)..(824): Xaa can be any naturally occurring amino acid except Pro or Gly
  VARIANT (826)..(826): Xaa can be any naturally occurring amino acid
  VARIANT (827)..(827): Xaa can be any naturally occurring amino acid
  VARIANT (828)..(828): Xaa can be any naturally occurring amino acid
  VARIANT (830)..(830): Xaa can be any naturally occurring amino acid except Pro or Gly
  VARIANT (831)..(831): Xaa can be any naturally occurring amino acid except Pro or Gly
  VARIANT (833)..(833): Xaa can be any naturally occurring amino acid
  VARIANT (834)..(834): Xaa can be any naturally occurring amino acid
  VARIANT (835)..(835): Xaa can be any naturally occurring amino acid
  VARIANT (837)..(837): Xaa can be any naturally occurring amino acid except Pro or Gly
  VARIANT (838)..(838): Xaa can be any naturally occurring amino acid except Pro or Gly
  VARIANT (840)..(840): Xaa can be any naturally occurring amino acid
  VARIANT (841)..(841): Xaa can be any naturally occurring amino acid
  VARIANT (842)..(842): Xaa can be any naturally occurring amino acid
  VARIANT (844)..(844): Xaa can be any naturally occurring amino acid except Pro or Gly
  VARIANT (845)..(845): Xaa can be any naturally occurring amino acid except Pro or Gly
  VARIANT (847)..(847): Xaa can be any naturally occurring amino acid
  VARIANT (848)..(848): Xaa can be any naturally occurring amino acid
  VARIANT (849)..(849): Xaa can be any naturally occurring amino acid
  VARIANT (851)..(851): Xaa can be any naturally occurring amino acid except Pro or Gly
  VARIANT (852)..(852): Xaa can be any naturally occurring amino acid except Pro or Gly
  VARIANT (854)..(854): Xaa can be any naturally occurring amino acid
  VARIANT (855)..(855): Xaa can be any naturally occurring amino acid
  VARIANT (856)..(856): Xaa can be any naturally occurring amino acid
  VARIANT (858)..(858): Xaa can be any naturally occurring amino acid except Pro or Gly
  VARIANT (859)..(859): Xaa can be any naturally occurring amino acid except Pro or Gly
  VARIANT (861)..(861): Xaa can be any naturally occurring amino acid
  VARIANT (862)..(862): Xaa can be any naturally occurring amino acid
  VARIANT (863)..(863): Xaa can be any naturally occurring amino acid
  VARIANT (865)..(865): Xaa can be any naturally occurring amino acid except Pro or Gly
  VARIANT (866)..(866): Xaa can be any naturally occurring amino acid except Pro or Gly
  VARIANT (868)..(868): Xaa can be any naturally occurring amino acid
  VARIANT (869)..(869): Xaa can be any naturally occurring amino acid
  VARIANT (870)..(870): Xaa can be any naturally occurring amino acid
  VARIANT (872)..(872): Xaa can be any naturally occurring amino acid except Pro or Gly
  VARIANT (873)..(873): Xaa can be any naturally occurring amino acid except Pro or Gly
  VARIANT (875)..(875): Xaa can be any naturally occurring amino acid
  VARIANT (876)..(876): Xaa can be any naturally occurring amino acid
  VARIANT (877)..(877): Xaa can be any naturally occurring amino acid
  VARIANT (879)..(879): Xaa can be any naturally occurring amino acid except Pro or Gly
  VARIANT (880)..(880): Xaa can be any naturally occurring amino acid except Pro or Gly
  VARIANT (882)..(882): Xaa can be any naturally occurring amino acid
  VARIANT (883)..(883): Xaa can be any naturally occurring amino acid
  VARIANT (884)..(884): Xaa can be any naturally occurring amino acid
  VARIANT (886)..(886): Xaa can be any naturally occurring amino acid except Pro or Gly
  VARIANT (887)..(887): Xaa can be any naturally occurring amino acid except Pro or Gly
  VARIANT (889)..(889): Xaa can be any naturally occurring amino acid
  VARIANT (890)..(890): Xaa can be any naturally occurring amino acid
  VARIANT (891)..(891): Xaa can be any naturally occurring amino acid
  VARIANT (893)..(893): Xaa can be any naturally occurring amino acid except Pro or Gly
  VARIANT (894)..(894): Xaa can be any naturally occurring amino acid except Pro or Gly
  VARIANT (896)..(896): Xaa can be any naturally occurring amino acid
  VARIANT (897)..(897): Xaa can be any naturally occurring amino acid
  VARIANT (898)..(898): Xaa can be any naturally occurring amino acid
  VARIANT (900)..(900): Xaa can be any naturally occurring amino acid except Pro or Gly
  VARIANT (901)..(901): Xaa can be any naturally occurring amino acid except Pro or Gly
  VARIANT (903)..(903): Xaa can be any naturally occurring amino acid
  VARIANT (904)..(904): Xaa can be any naturally occurring amino acid
  VARIANT (905)..(905): Xaa can be any naturally occurring amino acid
  VARIANT (907)..(907): Xaa can be any naturally occurring amino acid except Pro or Gly
  VARIANT (908)..(908): Xaa can be any naturally occurring amino acid except Pro or Gly
  VARIANT (910)..(910): Xaa can be any naturally occurring amino acid
  VARIANT (911)..(911): Xaa can be any naturally occurring amino acid
  VARIANT (912)..(912): Xaa can be any naturally occurring amino acid
  VARIANT (914)..(914): Xaa can be any naturally occurring amino acid except Pro or Gly
  VARIANT (915)..(915): Xaa can be any naturally occurring amino acid except Pro or Gly
  VARIANT (917)..(917): Xaa can be any naturally occurring amino acid
  VARIANT (918)..(918): Xaa can be any naturally occurring amino acid
  VARIANT (919)..(919): Xaa can be any naturally occurring amino acid
  VARIANT (921)..(921): Xaa can be any naturally occurring amino acid except Pro or Gly
  VARIANT (922)..(922): Xaa can be any naturally occurring amino acid except Pro or Gly
  VARIANT (924)..(924): Xaa can be any naturally occurring amino acid
  VARIANT (925)..(925): Xaa can be any naturally occurring amino acid
  VARIANT (926)..(926): Xaa can be any naturally occurring amino acid
  VARIANT (928)..(928): Xaa can be any naturally occurring amino acid except Pro or Gly
  VARIANT (929)..(929): Xaa can be any naturally occurring amino acid except Pro or Gly
  VARIANT (931)..(931): Xaa can be any naturally occurring amino acid
  VARIANT (932)..(932): Xaa can be any naturally occurring amino acid
  VARIANT (933)..(933): Xaa can be any naturally occurring amino acid
  VARIANT (935)..(935): Xaa can be any naturally occurring amino acid except Pro or Gly
  VARIANT (936)..(936): Xaa can be any naturally occurring amino acid except Pro or Gly
  VARIANT (938)..(938): Xaa can be any naturally occurring amino acid
  VARIANT (939)..(939): Xaa can be any naturally occurring amino acid
  VARIANT (940)..(940): Xaa can be any naturally occurring amino acid
  VARIANT (942)..(942): Xaa can be any naturally occurring amino acid except Pro or Gly
  VARIANT (943)..(943): Xaa can be any naturally occurring amino acid except Pro or Gly
  VARIANT (945)..(945): Xaa can be any naturally occurring amino acid
  VARIANT (946)..(946): Xaa can be any naturally occurring amino acid
  VARIANT (947)..(947): Xaa can be any naturally occurring amino acid
  VARIANT (949)..(949): Xaa can be any naturally occurring amino acid except Pro or Gly
  VARIANT (950)..(950): Xaa can be any naturally occurring amino acid except Pro or Gly
  VARIANT (952)..(952): Xaa can be any naturally occurring amino acid
  VARIANT (953)..(953): Xaa can be any naturally occurring amino acid
  VARIANT (954)..(954): Xaa can be any naturally occurring amino acid
  VARIANT (956)..(956): Xaa can be any naturally occurring amino acid except Pro or Gly
  VARIANT (957)..(957): Xaa can be any naturally occurring amino acid except Pro or Gly
  VARIANT (959)..(959): Xaa can be any naturally occurring amino acid
  VARIANT (960)..(960): Xaa can be any naturally occurring amino acid
  VARIANT (961)..(961): Xaa can be any naturally occurring amino acid
  VARIANT (963)..(963): Xaa can be any naturally occurring amino acid except Pro or Gly
  VARIANT (964)..(964): Xaa can be any naturally occurring amino acid except Pro or Gly
  VARIANT (966)..(966): Xaa can be any naturally occurring amino acid
  VARIANT (967)..(967): Xaa can be any naturally occurring amino acid
  VARIANT (968)..(968): Xaa can be any naturally occurring amino acid
  VARIANT (970)..(970): Xaa can be any naturally occurring amino acid except Pro or Gly
  VARIANT (971)..(971): Xaa can be any naturally occurring amino acid except Pro or Gly
  VARIANT (973)..(973): Xaa can be any naturally occurring amino acid
  VARIANT (974)..(974): Xaa can be any naturally occurring amino acid
  VARIANT (975)..(975): Xaa can be any naturally occurring amino acid
  VARIANT (977)..(977): Xaa can be any naturally occurring amino acid except Pro or Gly
  VARIANT (978)..(978): Xaa can be any naturally occurring amino acid except Pro or Gly
  VARIANT (980)..(980): Xaa can be any naturally occurring amino acid
  VARIANT (981)..(981): Xaa can be any naturally occurring amino acid
  VARIANT (982)..(982): Xaa can be any naturally occurring amino acid
  VARIANT (984)..(984): Xaa can be any naturally occurring amino acid except Pro or Gly
  VARIANT (985)..(985): Xaa can be any naturally occurring amino acid except Pro or Gly
  VARIANT (987)..(987): Xaa can be any naturally occurring amino acid
  VARIANT (988)..(988): Xaa can be any naturally occurring amino acid
  VARIANT (989)..(989): Xaa can be any naturally occurring amino acid
  VARIANT (991)..(991): Xaa can be any naturally occurring amino acid except Pro or Gly
  VARIANT (992)..(992): Xaa can be any naturally occurring amino acid except Pro or Gly
  VARIANT (994)..(994): Xaa can be any naturally occurring amino acid
  VARIANT (995)..(995): Xaa can be any naturally occurring amino acid
  VARIANT (996)..(996): Xaa can be any naturally occurring amino acid
  VARIANT (998)..(998): Xaa can be any naturally occurring amino acid except Pro or Gly
  VARIANT (999)..(999): Xaa can be any naturally occurring amino acid except Pro or Gly
  VARIANT (1001)..(1001): Xaa can be any naturally occurring amino acid
  VARIANT (1002)..(1002): Xaa can be any naturally occurring amino acid
  VARIANT (1003)..(1003): Xaa can be any naturally occurring amino acid
  VARIANT (1005)..(1005): Xaa can be any naturally occurring amino acid except Pro or Gly
  VARIANT (1006)..(1006): Xaa can be any naturally occurring amino acid except Pro or Gly
  VARIANT (1008)..(1008): Xaa can be any naturally occurring amino acid
  VARIANT (1009)..(1009): Xaa can be any naturally occurring amino acid
  VARIANT (1010)..(1010): Xaa can be any naturally occurring amino acid
  VARIANT (1012)..(1012): Xaa can be any naturally occurring amino acid except Pro or Gly
  VARIANT (1013)..(1013): Xaa can be any naturally occurring amino acid except Pro or Gly
  VARIANT (1015)..(1015): Xaa can be any naturally occurring amino acid
  VARIANT (1016)..(1016): Xaa can be any naturally occurring amino acid
  VARIANT (1017)..(1017): Xaa can be any naturally occurring amino acid
  VARIANT (1019)..(1019): Xaa can be any naturally occurring amino acid except Pro or Gly
  VARIANT (1020)..(1020): Xaa can be any naturally occurring amino acid except Pro or Gly
  VARIANT (1022)..(1022): Xaa can be any naturally occurring amino acid
  VARIANT (1023)..(1023): Xaa can be any naturally occurring amino acid
  VARIANT (1024)..(1024): Xaa can be any naturally occurring amino acid
  VARIANT (1026)..(1026): Xaa can be any naturally occurring amino acid except Pro or Gly
  VARIANT (1027)..(1027): Xaa can be any naturally occurring amino acid except Pro or Gly
  VARIANT (1029)..(1029): Xaa can be any naturally occurring amino acid
  VARIANT (1030)..(1030): Xaa can be any naturally occurring amino acid
  VARIANT (1031)..(1031): Xaa can be any naturally occurring amino acid
  VARIANT (1033)..(1033): Xaa can be any naturally occurring amino acid except Pro or Gly
  VARIANT (1034)..(1034): Xaa can be any naturally occurring amino acid except Pro or Gly
  VARIANT (1036)..(1036): Xaa can be any naturally occurring amino acid
  VARIANT (1037)..(1037): Xaa can be any naturally occurring amino acid
  VARIANT (1038)..(1038): Xaa can be any naturally occurring amino acid
  VARIANT (1040)..(1040): Xaa can be any naturally occurring amino acid except Pro or Gly
  VARIANT (1041)..(1041): Xaa can be any naturally occurring amino acid except Pro or Gly
  VARIANT (1043)..(1043): Xaa can be any naturally occurring amino acid
  VARIANT (1044)..(1044): Xaa can be any naturally occurring amino acid
  VARIANT (1045)..(1045): Xaa can be any naturally occurring amino acid
  VARIANT (1047)..(1047): Xaa can be any naturally occurring amino acid except Pro or Gly
  VARIANT (1048)..(1048): Xaa can be any naturally occurring amino acid except Pro or Gly
  VARIANT (1050)..(1050): Xaa can be any naturally occurring amino acid
  VARIANT (1051)..(1051): Xaa can be any naturally occurring amino acid
  VARIANT (1052)..(1052): Xaa can be any naturally occurring amino acid
  VARIANT (1054)..(1054): Xaa can be any naturally occurring amino acid except Pro or Gly
  VARIANT (1055)..(1055): Xaa can be any naturally occurring amino acid except Pro or Gly
  VARIANT (1057)..(1057): Xaa can be any naturally occurring amino acid
  VARIANT (1058)..(1058): Xaa can be any naturally occurring amino acid
  VARIANT (1059)..(1059): Xaa can be any naturally occurring amino acid
  VARIANT (1061)..(1061): Xaa can be any naturally occurring amino acid except Pro or Gly
  VARIANT (1062)..(1062): Xaa can be any naturally occurring amino acid except Pro or Gly
  VARIANT (1064)..(1064): Xaa can be any naturally occurring amino acid
  VARIANT (1065)..(1065): Xaa can be any naturally occurring amino acid
  VARIANT (1066)..(1066): Xaa can be any naturally occurring amino acid
  VARIANT (1068)..(1068): Xaa can be any naturally occurring amino acid except Pro or Gly
  VARIANT (1069)..(1069): Xaa can be any naturally occurring amino acid except Pro or Gly
  VARIANT (1071)..(1071): Xaa can be any naturally occurring amino acid
  VARIANT (1072)..(1072): Xaa can be any naturally occurring amino acid
  VARIANT (1073)..(1073): Xaa can be any naturally occurring amino acid
  VARIANT (1075)..(1075): Xaa can be any naturally occurring amino acid except Pro or Gly
  VARIANT (1076)..(1076): Xaa can be any naturally occurring amino acid except Pro or Gly
  VARIANT (1078)..(1078): Xaa can be any naturally occurring amino acid
  VARIANT (1079)..(1079): Xaa can be any naturally occurring amino acid
  VARIANT (1080)..(1080): Xaa can be any naturally occurring amino acid
  VARIANT (1082)..(1082): Xaa can be any naturally occurring amino acid except Pro or Gly
  VARIANT (1083)..(1083): Xaa can be any naturally occurring amino acid except Pro or Gly
  VARIANT (1085)..(1085): Xaa can be any naturally occurring amino acid
  VARIANT (1086)..(1086): Xaa can be any naturally occurring amino acid
  VARIANT (1087)..(1087): Xaa can be any naturally occurring amino acid
  VARIANT (1089)..(1089): Xaa can be any naturally occurring amino acid except Pro or Gly
  VARIANT (1090)..(1090): Xaa can be any naturally occurring amino acid except Pro or Gly
  VARIANT (1092)..(1092): Xaa can be any naturally occurring amino acid
  VARIANT (1093)..(1093): Xaa can be any naturally occurring amino acid
  VARIANT (1094)..(1094): Xaa can be any naturally occurring amino acid
  VARIANT (1096)..(1096): Xaa can be any naturally occurring amino acid except Pro or Gly
  VARIANT (1097)..(1097): Xaa can be any naturally occurring amino acid except Pro or Gly
  VARIANT (1099)..(1099): Xaa can be any naturally occurring amino acid
  VARIANT (1100)..(1100): Xaa can be any naturally occurring amino acid
  VARIANT (1101)..(1101): Xaa can be any naturally occurring amino acid
  VARIANT (1103)..(1103): Xaa can be any naturally occurring amino acid except Pro or Gly
  VARIANT (1104)..(1104): Xaa can be any naturally occurring amino acid except Pro or Gly
  VARIANT (1106)..(1106): Xaa can be any naturally occurring amino acid
  VARIANT (1107)..(1107): Xaa can be any naturally occurring amino acid
  VARIANT (1108)..(1108): Xaa can be any naturally occurring amino acid
  VARIANT (1110)..(1110): Xaa can be any naturally occurring amino acid except Pro or Gly
  VARIANT (1111)..(1111): Xaa can be any naturally occurring amino acid except Pro or Gly
  VARIANT (1113)..(1113): Xaa can be any naturally occurring amino acid
  VARIANT (1114)..(1114): Xaa can be any naturally occurring amino acid
  VARIANT (1115)..(1115): Xaa can be any naturally occurring amino acid
  VARIANT (1117)..(1117): Xaa can be any naturally occurring amino acid except Pro or Gly
  VARIANT (1118)..(1118): Xaa can be any naturally occurring amino acid except Pro or Gly
  VARIANT (1120)..(1120): Xaa can be any naturally occurring amino acid
XXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGX

SEQ ID NO: 151 - protein, 1280 aa, Artificial Sequence
  elastin-like polypeptide
  VARIANT (1)..(1): Xaa can be any naturally occurring amino acid
  VARIANT (2)..(2): Xaa can be any naturally occurring amino acid
  VARIANT (4)..(4): Xaa can be any naturally occurring amino acid except Pro or Gly
  VARIANT (5)..(5): Xaa can be any naturally occurring amino acid except Pro or Gly
  VARIANT (6)..(6): Xaa can be any naturally occurring amino acid except Pro or Gly
  VARIANT (8)..(8): Xaa can be any naturally occurring amino acid
  VARIANT (9)..(9): Xaa can be any naturally occurring amino acid
  VARIANT (10)..(10): Xaa can be any naturally occurring amino acid
  VARIANT (12)..(12): Xaa can be any naturally occurring amino acid except Pro or Gly
  VARIANT (13)..(13): Xaa can be any naturally occurring amino acid except Pro or Gly
  VARIANT (14)..(14): Xaa can be any naturally occurring amino acid except Pro or Gly
  VARIANT (16)..(16): Xaa can be any naturally occurring amino acid
  VARIANT (17)..(17): Xaa can be any naturally occurring amino acid
  VARIANT (18)..(18): Xaa can be any naturally occurring amino acid
  VARIANT (20)..(20): Xaa can be any naturally occurring amino acid except Pro or Gly
  VARIANT (21)..(21): Xaa can be any naturally occurring amino acid except Pro or Gly
  VARIANT (22)..(22): Xaa can be any naturally occurring amino acid except Pro or Gly
  VARIANT (24)..(24): Xaa can be any naturally occurring amino acid
  VARIANT (25)..(25): Xaa can be any naturally occurring amino acid
  VARIANT (26)..(26): Xaa can be any naturally occurring amino acid
  VARIANT (28)..(28): Xaa can be any naturally occurring amino acid except Pro or Gly
  VARIANT (29)..(29): Xaa can be any naturally occurring amino acid except Pro or Gly
  VARIANT (30)..(30): Xaa can be any naturally occurring amino acid except Pro or Gly
  VARIANT (32)..(32): Xaa can be any naturally occurring amino acid
  VARIANT (33)..(33): Xaa can be any naturally occurring amino acid
  VARIANT (34)..(34): Xaa can be any naturally occurring amino acid
  VARIANT (36)..(36): Xaa can be any naturally occurring amino acid except Pro or Gly
  VARIANT (37)..(37): Xaa can be any naturally occurring amino acid except Pro or Gly
  VARIANT (38)..(38): Xaa can be any naturally occurring amino acid except Pro or Gly
  VARIANT (40)..(40): Xaa can be any naturally occurring amino acid
  VARIANT (41)..(41): Xaa can be any naturally occurring amino acid
  VARIANT (42)..(42): Xaa can be any naturally occurring amino acid
  VARIANT (44)..(44): Xaa can be any naturally occurring amino acid except Pro or Gly
  VARIANT (45)..(45): Xaa can be any naturally occurring amino acid except Pro or Gly
  VARIANT (46)..(46): Xaa can be any naturally occurring amino acid except Pro or Gly
  VARIANT (48)..(48): Xaa can be any naturally occurring amino acid
  VARIANT (49)..(49): Xaa can be any naturally occurring amino acid
  VARIANT (50)..(50): Xaa can be any naturally occurring amino acid
  VARIANT (52)..(52): Xaa can be any naturally occurring amino acid except Pro or Gly
  VARIANT (53)..(53): Xaa can be any naturally occurring amino acid except Pro or Gly
  VARIANT (54)..(54): Xaa can be any naturally occurring amino acid except Pro or Gly
  VARIANT (56)..(56): Xaa can be any naturally occurring amino acid
  VARIANT (57)..(57): Xaa can be any naturally occurring amino acid
  VARIANT (58)..(58): Xaa can be any naturally occurring amino acid
  VARIANT (60)..(60): Xaa can be any naturally occurring amino acid except Pro or Gly
  VARIANT (61)..(61): Xaa can be any naturally occurring amino acid except Pro or Gly
  VARIANT (62)..(62): Xaa can be any naturally occurring amino acid except Pro or Gly
  VARIANT (64)..(64): Xaa can be any naturally occurring amino acid
  VARIANT (65)..(65): Xaa can be any naturally occurring amino acid
  VARIANT (66)..(66): Xaa can be any naturally occurring amino acid
  VARIANT (68)..(68): Xaa can be any naturally occurring amino acid except Pro or Gly
  VARIANT (69)..(69): Xaa can be any naturally occurring amino acid except Pro or Gly
  VARIANT (70)..(70): Xaa can be any naturally occurring amino acid except Pro or Gly
  VARIANT (72)..(72): Xaa can be any naturally occurring amino acid
  VARIANT (73)..(73): Xaa can be any naturally occurring amino acid
  VARIANT (74)..(74): Xaa can be any naturally occurring amino acid
  VARIANT (76)..(76): Xaa can be any naturally occurring amino acid except Pro or Gly
  VARIANT (77)..(77): Xaa can be any naturally occurring amino acid except Pro or Gly
  VARIANT (78)..(78): Xaa can be any naturally occurring amino acid except Pro or Gly
  VARIANT (80)..(80): Xaa can be any naturally occurring amino acid
  VARIANT (81)..(1280): May be present or absent in groups of the repeat unit Xaa Xaa Pro Xaa Xaa Xaa Gly Xaa
  VARIANT (81)..(81): Xaa can be any naturally occurring amino acid
  VARIANT (82)..(82): Xaa can be any naturally occurring amino acid
  VARIANT (84)..(84): Xaa can be any naturally occurring amino acid except Pro or Gly
  VARIANT (85)..(85): Xaa can be any naturally occurring amino acid except Pro or Gly
  VARIANT (86)..(86): Xaa can be any naturally occurring amino acid except Pro or Gly
  VARIANT (88)..(88): Xaa can be any naturally occurring amino acid
  VARIANT (89)..(89): Xaa can be any naturally occurring amino acid
  VARIANT (90)..(90): Xaa can be any naturally occurring amino acid
  VARIANT (92)..(92): Xaa can be any naturally occurring amino acid except Pro or Gly
  VARIANT (93)..(93): Xaa can be any naturally occurring amino acid except Pro or Gly
  VARIANT (94)..(94): Xaa can be any naturally occurring amino acid except Pro or Gly
  VARIANT (96)..(96): Xaa can be any naturally occurring amino acid
  VARIANT (97)..(97): Xaa can be any naturally occurring amino acid
  VARIANT (98)..(98): Xaa can be any naturally occurring amino acid
  VARIANT (100)..(100): Xaa can be any naturally occurring amino acid except Pro or Gly
  VARIANT (101)..(101): Xaa can be any naturally occurring amino acid except Pro or Gly
  VARIANT (102)..(102): Xaa can be any naturally occurring amino acid except Pro or Gly
  VARIANT (104)..(104): Xaa can be any naturally occurring amino acid
  VARIANT (105)..(105): Xaa can be any naturally occurring amino acid
  VARIANT (106)..(106): Xaa can be any naturally occurring amino acid
  VARIANT (108)..(108): Xaa can be any naturally occurring amino acid except Pro or Gly
  VARIANT (109)..(109): Xaa can be any naturally occurring amino acid except Pro or Gly
  VARIANT (110)..(110): Xaa can be any naturally occurring amino acid except Pro or Gly
  VARIANT (112)..(112): Xaa can be any naturally occurring amino acid
  VARIANT (113)..(113): Xaa can be any naturally occurring amino acid
  VARIANT (114)..(114): Xaa can be any naturally occurring amino acid
  VARIANT (116)..(116): Xaa can be any naturally occurring amino acid except Pro or Gly
  VARIANT (117)..(117): Xaa can be any naturally occurring amino acid except Pro or Gly
  VARIANT (118)..(118): Xaa can be any naturally occurring amino acid except Pro or Gly
  VARIANT (120)..(120): Xaa can be any naturally occurring amino acid
  VARIANT (121)..(121): Xaa can be any naturally occurring amino acid
  VARIANT (122)..(122): Xaa can be any naturally occurring amino acid
  VARIANT (124)..(124): Xaa can be any naturally occurring amino acid except Pro or Gly
  VARIANT (125)..(125): Xaa can be any naturally occurring amino acid except Pro or Gly
  VARIANT (126)..(126): Xaa can be any naturally occurring amino acid except Pro or Gly
  VARIANT (128)..(128): Xaa can be any naturally occurring amino acid
  VARIANT (129)..(129): Xaa can be any naturally occurring amino acid
  VARIANT (130)..(130): Xaa can be any naturally occurring amino acid
  VARIANT (132)..(132): Xaa can be any naturally occurring amino acid except Pro or Gly
  VARIANT (133)..(133): Xaa can be any naturally occurring amino acid except Pro or Gly
  VARIANT (134)..(134): Xaa can be any naturally occurring amino acid except Pro or Gly
  VARIANT (136)..(136): Xaa can be any naturally occurring amino acid
  VARIANT (137)..(137): Xaa can be any naturally occurring amino acid
  VARIANT (138)..(138): Xaa can be any naturally occurring amino acid
  VARIANT (140)..(140): Xaa can be any naturally occurring amino acid except Pro or Gly
  VARIANT (141)..(141): Xaa can be any naturally occurring amino acid except Pro or Gly
  VARIANT (142)..(142): Xaa can be any naturally occurring amino acid except Pro or Gly
  VARIANT (144)..(144): Xaa can be any naturally occurring amino acid
  VARIANT (145)..(145): Xaa can be any naturally occurring amino acid
  VARIANT (146)..(146): Xaa can be any naturally occurring amino acid
  VARIANT (148)..(148): Xaa can be any naturally occurring amino acid except Pro or Gly
  VARIANT (149)..(149): Xaa can be any naturally occurring amino acid except Pro or Gly
  VARIANT (150)..(150): Xaa can be any naturally occurring amino acid except Pro or Gly
  VARIANT (152)..(152): Xaa can be any naturally occurring amino acid
  VARIANT (153)..(153): Xaa can be any naturally occurring amino acid
  VARIANT (154)..(154): Xaa can be any naturally occurring amino acid
  VARIANT (156)..(156): Xaa can be any naturally occurring amino acid except Pro or Gly
  VARIANT (157)..(157): Xaa can be any naturally occurring amino acid except Pro or Gly
  VARIANT (158)..(158): Xaa can be any naturally occurring amino acid except Pro or Gly
  VARIANT (160)..(160): Xaa can be any naturally occurring amino acid
  VARIANT (161)..(161): Xaa can be any naturally occurring amino acid
  VARIANT (162)..(162): Xaa can be any naturally occurring amino acid
  VARIANT (164)..(164): Xaa can be any naturally occurring amino acid except Pro or Gly
  VARIANT (165)..(165): Xaa can be any naturally occurring amino acid except Pro or Gly
  VARIANT (166)..(166): Xaa can be any naturally occurring amino acid except Pro or Gly
  VARIANT (168)..(168): Xaa can be any naturally occurring amino acid
  VARIANT (169)..(169): Xaa can be any naturally occurring amino acid
  VARIANT (170)..(170): Xaa can be any naturally occurring amino acid
  VARIANT (172)..(172): Xaa can be any naturally occurring amino acid except Pro or Gly
  VARIANT (173)..(173): Xaa can be any naturally occurring amino acid except Pro or Gly
  VARIANT (174)..(174): Xaa can be any naturally occurring amino acid except Pro or Gly
  VARIANT (176)..(176): Xaa can be any naturally occurring amino acid
  VARIANT (177)..(177): Xaa can be any naturally occurring amino acid
  VARIANT (178)..(178): Xaa can be any naturally occurring amino acid
  VARIANT (180)..(180): Xaa can be any naturally occurring amino acid except Pro or Gly
  VARIANT (181)..(181): Xaa can be any naturally occurring amino acid except Pro or Gly
  VARIANT (182)..(182): Xaa can be any naturally occurring amino acid except Pro or Gly
  VARIANT (184)..(184): Xaa can be any naturally occurring amino acid
  VARIANT (185)..(185): Xaa can be any naturally occurring amino acid
  VARIANT (186)..(186): Xaa can be any naturally occurring amino acid
  VARIANT (188)..(188): Xaa can be any naturally occurring amino acid except Pro or Gly
  VARIANT (189)..(189): Xaa can be any naturally occurring amino acid except Pro or Gly
  VARIANT (190)..(190): Xaa can be any naturally occurring amino acid except Pro or Gly
  VARIANT (192)..(192): Xaa can be any naturally occurring amino acid
  VARIANT (193)..(193): Xaa can be any naturally occurring amino acid
  VARIANT (194)..(194): Xaa can be any naturally occurring amino acid
  VARIANT (196)..(196): Xaa can be any naturally occurring amino acid except Pro or Gly
  VARIANT (197)..(197): Xaa can be any naturally occurring amino acid except Pro or Gly
  VARIANT (198)..(198): Xaa can be any naturally occurring amino acid except Pro or Gly
  VARIANT (200)..(200): Xaa can be any naturally occurring amino acid
  VARIANT (201)..(201): Xaa can be any naturally occurring amino acid
  VARIANT (202)..(202): Xaa can be any naturally occurring amino acid
  VARIANT (204)..(204): Xaa can be any naturally occurring amino acid except Pro or Gly
  VARIANT (205)..(205): Xaa can be any naturally occurring amino acid except Pro or Gly
  VARIANT (206)..(206): Xaa can be any naturally occurring amino acid except Pro or Gly
  VARIANT (208)..(208): Xaa can be any naturally occurring amino acid
  VARIANT (209)..(209): Xaa can be any naturally occurring amino acid
  VARIANT (210)..(210): Xaa can be any naturally occurring amino acid
  VARIANT (212)..(212): Xaa can be any naturally occurring amino acid except Pro or Gly
  VARIANT (213)..(213): Xaa can be any naturally occurring amino acid except Pro or Gly
  VARIANT (214)..(214): Xaa can be any naturally occurring amino acid except Pro or Gly
  VARIANT (216)..(216): Xaa can be any naturally occurring amino acid
  VARIANT (217)..(217): Xaa can be any naturally occurring amino acid
  VARIANT (218)..(218): Xaa can be any naturally occurring amino acid
  VARIANT (220)..(220): Xaa can be any naturally occurring amino acid except Pro or Gly
  VARIANT (221)..(221): Xaa can be any naturally occurring amino acid except Pro or Gly
  VARIANT (222)..(222): Xaa can be any naturally occurring amino acid except Pro or Gly
  VARIANT (224)..(224): Xaa can be any naturally occurring amino acid
  VARIANT (225)..(225): Xaa can be any naturally occurring amino acid
  VARIANT (226)..(226): Xaa can be any naturally occurring amino acid
  VARIANT (228)..(228): Xaa can be any naturally occurring amino acid except Pro or Gly
  VARIANT (229)..(229): Xaa can be any naturally occurring amino acid except Pro or Gly
  VARIANT (230)..(230): Xaa can be any naturally occurring amino acid except Pro or Gly
  VARIANT (232)..(232): Xaa can be any naturally occurring amino acid
  VARIANT (233)..(233): Xaa can be any naturally occurring amino acid
  VARIANT (234)..(234): Xaa can be any naturally occurring amino acid
  VARIANT (236)..(236): Xaa can be any naturally occurring amino acid except Pro or Gly
  VARIANT (237)..(237): Xaa can be any naturally occurring amino acid except Pro or Gly
  VARIANT (238)..(238): Xaa can be any naturally occurring amino acid except Pro or Gly
  VARIANT (240)..(240): Xaa can be any naturally occurring amino acid
  VARIANT (241)..(241): Xaa can be any naturally occurring amino acid
  VARIANT (242)..(242): Xaa can be any naturally occurring amino acid
  VARIANT (244)..(244): Xaa can be any naturally occurring amino acid except Pro or Gly
  VARIANT (245)..(245): Xaa can be any naturally occurring amino acid except Pro or Gly
  VARIANT (246)..(246): Xaa can be any naturally occurring amino acid except Pro or Gly
  VARIANT (248)..(248): Xaa can be any naturally occurring amino acid
  VARIANT (249)..(249): Xaa can be any naturally occurring amino acid
  VARIANT (250)..(250): Xaa can be any naturally occurring amino acid
  VARIANT (252)..(252): Xaa can be any naturally occurring amino acid except Pro or Gly
  VARIANT (253)..(253): Xaa can be any naturally occurring amino acid except Pro or Gly
  VARIANT (254)..(254): Xaa can be any naturally occurring amino acid except Pro or Gly
  VARIANT (256)..(256): Xaa can be any naturally occurring amino acid
  VARIANT (257)..(257): Xaa can be any naturally occurring amino acid
  VARIANT (258)..(258): Xaa can be any naturally occurring amino acid
  VARIANT (260)..(260): Xaa can be any naturally occurring amino acid except Pro or Gly
  VARIANT (261)..(261): Xaa can be any naturally occurring amino acid except Pro or Gly
  VARIANT (262)..(262): Xaa can be any naturally occurring amino acid except Pro or Gly
  VARIANT (264)..(264): Xaa can be any naturally occurring amino acid
  VARIANT (265)..(265): Xaa can be any naturally occurring amino acid
  VARIANT (266)..(266): Xaa can be any naturally occurring amino acid
  VARIANT (268)..(268): Xaa can be any naturally occurring amino acid except Pro or Gly
  VARIANT (269)..(269): Xaa can be any naturally occurring amino acid except Pro or Gly
  VARIANT (270)..(270): Xaa can be any naturally occurring amino acid except Pro or Gly
  VARIANT (272)..(272): Xaa can be any naturally occurring amino acid
  VARIANT (273)..(273): Xaa can be any naturally occurring amino acid
  VARIANT (274)..(274): Xaa can be any naturally occurring amino acid
  VARIANT (276)..(276): Xaa can be any naturally occurring amino acid except Pro or Gly
  VARIANT (277)..(277): Xaa can be any naturally occurring amino acid except Pro or Gly
  VARIANT (278)..(278): Xaa can be any naturally occurring amino acid except Pro or Gly
  VARIANT (280)..(280): Xaa can be any naturally occurring amino acid
  VARIANT (281)..(281): Xaa can be any naturally occurring amino acid
  VARIANT (282)..(282): Xaa can be any naturally occurring amino acid
  VARIANT (284)..(284): Xaa can be any naturally occurring amino acid except Pro or Gly
  VARIANT (285)..(285): Xaa can be any naturally occurring amino acid except Pro or Gly
  VARIANT (286)..(286): Xaa can be any naturally occurring amino acid except Pro or Gly
  VARIANT (288)..(288): Xaa can be any naturally occurring amino acid
  VARIANT (289)..(289): Xaa can be any naturally occurring amino acid
  VARIANT (290)..(290): Xaa can be any naturally occurring amino acid
  VARIANT (292)..(292): Xaa can be any naturally occurring amino acid except Pro or Gly
  VARIANT (293)..(293): Xaa can be any naturally occurring amino acid except Pro or Gly
  VARIANT (294)..(294): Xaa can be any naturally occurring amino acid except Pro or Gly
  VARIANT (296)..(296): Xaa can be any naturally occurring amino acid
  VARIANT (297)..(297): Xaa can be any naturally occurring amino acid
  VARIANT (298)..(298): Xaa can be any naturally occurring amino acid
  VARIANT (300)..(300): Xaa can be any naturally occurring amino acid except Pro or Gly
  VARIANT (301)..(301): Xaa can be any naturally occurring amino acid except Pro or Gly
  VARIANT (302)..(302): Xaa can be any naturally occurring amino acid except Pro or Gly
  VARIANT (304)..(304): Xaa can be any naturally occurring amino acid
  VARIANT (305)..(305): Xaa can be any naturally occurring amino acid
  VARIANT (306)..(306): Xaa can be any naturally occurring amino acid
  VARIANT (308)..(308): Xaa can be any naturally occurring amino acid except Pro or Gly
  VARIANT (309)..(309): Xaa can be any naturally occurring amino acid except Pro or Gly
  VARIANT (310)..(310): Xaa can be any naturally occurring amino acid except Pro or Gly
  VARIANT (312)..(312): Xaa can be any naturally occurring amino acid
  VARIANT (313)..(313): Xaa can be any naturally occurring amino acid
  VARIANT (314)..(314): Xaa can be any naturally occurring amino acid
  VARIANT (316)..(316): Xaa can be any naturally occurring amino acid except Pro or Gly
  VARIANT (317)..(317): Xaa can be any naturally occurring amino acid except Pro or Gly
  VARIANT (318)..(318): Xaa can be any naturally occurring amino acid except Pro or Gly
  VARIANT (320)..(320): Xaa can be any naturally occurring amino acid
  VARIANT (321)..(321): Xaa can be any naturally occurring amino acid
  VARIANT (322)..(322): Xaa can be any naturally occurring amino acid
  VARIANT (324)..(324): Xaa can be any naturally occurring amino acid except Pro or Gly
  VARIANT (325)..(325): Xaa can be any naturally occurring amino acid except Pro or Gly
  VARIANT (326)..(326): Xaa can be any naturally occurring amino acid except Pro or Gly
  VARIANT (328)..(328): Xaa can be any naturally occurring amino acid
  VARIANT (329)..(329): Xaa can be any naturally occurring amino acid
  VARIANT (330)..(330): Xaa can be any naturally occurring amino acid
  VARIANT (332)..(332): Xaa can be any naturally occurring amino acid except Pro or Gly
  VARIANT (333)..(333): Xaa can be any naturally occurring amino acid except Pro or Gly
  VARIANT (334)..(334): Xaa can be any naturally occurring amino acid except Pro or Gly
  VARIANT (336)..(336): Xaa can be any naturally occurring amino acid
  VARIANT (337)..(337): Xaa can be any naturally occurring amino acid
  VARIANT (338)..(338): Xaa can be any naturally occurring amino acid
  VARIANT (340)..(340): Xaa can be any naturally occurring amino acid except Pro or Gly
  VARIANT (341)..(341): Xaa can be any naturally occurring amino acid except Pro or Gly
  VARIANT (342)..(342): Xaa can be any naturally occurring amino acid except Pro or Gly
  VARIANT (344)..(344): Xaa can be any naturally occurring amino acid
  VARIANT (345)..(345): Xaa can be any naturally occurring amino acid
  VARIANT (346)..(346): Xaa can be any naturally occurring amino acid
  VARIANT (348)..(348): Xaa can be any naturally occurring amino acid except Pro or Gly
  VARIANT (349)..(349): Xaa can be any naturally occurring amino acid except Pro or Gly
  VARIANT (350)..(350): Xaa can be any naturally occurring amino acid except Pro or Gly
  VARIANT (352)..(352): Xaa can be any naturally occurring amino acid
  VARIANT (353)..(353): Xaa can be any naturally occurring amino acid
  VARIANT (354)..(354): Xaa can be any naturally occurring amino acid
  VARIANT (356)..(356): Xaa can be any naturally occurring amino acid except Pro or Gly
  VARIANT (357)..(357): Xaa can be any naturally occurring amino acid except Pro or Gly
  VARIANT (358)..(358): Xaa can be any naturally occurring amino acid except Pro or Gly
  VARIANT (360)..(360): Xaa can be any naturally occurring amino acid
  VARIANT (361)..(361): Xaa can be any naturally occurring amino acid
  VARIANT (362)..(362): Xaa can be any naturally occurring amino acid
  VARIANT (364)..(364): Xaa can be any naturally occurring amino acid except Pro or Gly
  VARIANT (365)..(365): Xaa can be any naturally occurring amino acid except Pro or Gly
  VARIANT (366)..(366): Xaa can be any naturally occurring amino acid except Pro or Gly
  VARIANT (368)..(368): Xaa can be any naturally occurring amino acid
  VARIANT (369)..(369): Xaa can be any naturally occurring amino acid
  VARIANT (370)..(370): Xaa can be any naturally occurring amino acid
  VARIANT (372)..(372): Xaa can be any naturally occurring amino acid except Pro or Gly
  VARIANT (373)..(373): Xaa can be any naturally occurring amino acid except Pro or Gly
  VARIANT (374)..(374): Xaa can be any naturally occurring amino acid except Pro or Gly
  VARIANT (376)..(376): Xaa can be any naturally occurring amino acid
  VARIANT (377)..(377): Xaa can be any naturally occurring amino acid
  VARIANT (378)..(378): Xaa can be any naturally occurring amino acid
  VARIANT (380)..(380): Xaa can be any naturally occurring amino acid except Pro or Gly
  VARIANT (381)..(381): Xaa can be any naturally occurring amino acid except Pro or Gly
  VARIANT (382)..(382): Xaa can be any naturally occurring amino acid except Pro or Gly
  VARIANT (384)..(384): Xaa can be any naturally occurring amino acid
  VARIANT (385)..(385): Xaa can be any naturally occurring amino acid
  VARIANT (386)..(386): Xaa can be any naturally occurring amino acid
  VARIANT (388)..(388): Xaa can be any naturally occurring amino acid except Pro or Gly
  VARIANT (389)..(389): Xaa can be any naturally occurring amino acid except Pro or Gly
  VARIANT (390)..(390): Xaa can be any naturally occurring amino acid except Pro or Gly
  VARIANT (392)..(392): Xaa can be any naturally occurring amino acid
  VARIANT (393)..(393): Xaa can be any naturally occurring amino acid
  VARIANT (394)..(394): Xaa can be any naturally occurring amino acid
  VARIANT (396)..(396): Xaa can be any naturally occurring amino acid except Pro or Gly
  VARIANT (397)..(397): Xaa can be any naturally occurring amino acid except Pro or Gly
  VARIANT (398)..(398): Xaa can be any naturally occurring amino acid except Pro or Gly
  VARIANT (400)..(400): Xaa can be any naturally occurring amino acid
  VARIANT (401)..(401): Xaa can be any naturally occurring amino acid
  VARIANT (402)..(402): Xaa can be any naturally occurring amino acid
  VARIANT (404)..(404): Xaa can be any naturally occurring amino acid except Pro or Gly
  VARIANT (405)..(405): Xaa can be any naturally occurring amino acid except Pro or Gly
  VARIANT (406)..(406): Xaa can be any naturally occurring amino acid except Pro or Gly
  VARIANT (408)..(408): Xaa can be any naturally occurring amino acid
  VARIANT (409)..(409): Xaa can be any naturally occurring amino acid
  VARIANT (410)..(410): Xaa can be any naturally occurring amino acid
  VARIANT (412)..(412): Xaa can be any naturally occurring amino acid except Pro or Gly
  VARIANT (413)..(413): Xaa can be any naturally occurring amino acid except Pro or Gly
  VARIANT (414)..(414): Xaa can be any naturally occurring amino acid except Pro or Gly
  VARIANT (416)..(416): Xaa can be any naturally occurring amino acid
  VARIANT (417)..(417): Xaa can be any naturally occurring amino acid
  VARIANT (418)..(418): Xaa can be any naturally occurring amino acid
  VARIANT (420)..(420): Xaa can be any naturally occurring amino acid except Pro or Gly
  VARIANT (421)..(421): Xaa can be any naturally occurring amino acid except Pro or Gly
  VARIANT (422)..(422): Xaa can be any naturally occurring amino acid except Pro or Gly
  VARIANT (424)..(424): Xaa can be any naturally occurring amino acid
  VARIANT (425)..(425): Xaa can be any naturally occurring amino acid
  VARIANT (426)..(426): Xaa can be any naturally occurring amino acid
  VARIANT (428)..(428): Xaa can be any naturally occurring amino acid except Pro or Gly
  VARIANT (429)..(429): Xaa can be any naturally occurring amino acid except Pro or Gly
  VARIANT (430)..(430): Xaa can be any naturally occurring amino acid except Pro or Gly
  VARIANT (432)..(432): Xaa can be any naturally occurring amino acid
  VARIANT (433)..(433): Xaa can be any naturally occurring amino acid
  VARIANT (434)..(434): Xaa can be any naturally occurring amino acid
  VARIANT (436)..(436): Xaa can be any naturally occurring amino acid except Pro or Gly
  VARIANT (437)..(437): Xaa can be any naturally occurring amino acid except Pro or Gly
  VARIANT (438)..(438): Xaa can be any naturally occurring amino acid except Pro or Gly
  VARIANT (440)..(440): Xaa can be any naturally occurring amino acid
  VARIANT (441)..(441): Xaa can be any naturally occurring amino acid
  VARIANT (442)..(442): Xaa can be any naturally occurring amino acid
  VARIANT (444)..(444): Xaa can be any naturally occurring amino acid except Pro or Gly
  VARIANT (445)..(445): Xaa can be any naturally occurring amino acid except Pro or Gly
  VARIANT (446)..(446): Xaa can be any naturally occurring amino acid except Pro or Gly
  VARIANT (448)..(448): Xaa can be any naturally occurring amino acid
  VARIANT (449)..(449): Xaa can be any naturally occurring amino acid
  VARIANT (450)..(450): Xaa can be any naturally occurring amino acid
  VARIANT (452)..(452): Xaa can be any naturally occurring amino acid except Pro or Gly
  VARIANT (453)..(453): Xaa can be any naturally occurring amino acid except Pro or Gly
  VARIANT (454)..(454): Xaa can be any naturally occurring amino acid except Pro or Gly
  VARIANT (456)..(456): Xaa can be any naturally occurring amino acid
  VARIANT (457)..(457): Xaa can be any naturally occurring amino acid
  VARIANT (458)..(458): Xaa can be any naturally occurring amino acid
  VARIANT (460)..(460): Xaa can be any naturally occurring amino acid except Pro or Gly
  VARIANT (461)..(461): Xaa can be any naturally occurring amino acid except Pro or Gly
  VARIANT (462)..(462): Xaa can be any naturally occurring amino acid except Pro or Gly
  VARIANT (464)..(464): Xaa can be any naturally occurring amino acid
  VARIANT (465)..(465): Xaa can be any naturally occurring amino acid
  VARIANT (466)..(466): Xaa can be any naturally occurring amino acid
  VARIANT (468)..(468): Xaa can be any naturally occurring amino acid except Pro or Gly
  VARIANT (469)..(469): Xaa can be any naturally occurring amino acid except Pro or Gly
  VARIANT (470)..(470): Xaa can be any naturally occurring amino acid except Pro or Gly
  VARIANT (472)..(472): Xaa can be any naturally occurring amino acid
  VARIANT (473)..(473): Xaa can be any naturally occurring amino acid
  VARIANT (474)..(474): Xaa can be any naturally occurring amino acid
  VARIANT (476)..(476): Xaa can be any naturally occurring amino acid except Pro or Gly
  VARIANT (477)..(477): Xaa can be any naturally occurring amino acid except Pro or Gly
  VARIANT (478)..(478): Xaa can be any naturally occurring amino acid except Pro or Gly
  VARIANT (480)..(480): Xaa can be any naturally occurring amino acid
  VARIANT (481)..(481): Xaa can be any naturally occurring amino acid
  VARIANT (482)..(482): Xaa can be any naturally occurring amino acid
  VARIANT (484)..(484): Xaa can be any naturally occurring amino acid except Pro or Gly
  VARIANT (485)..(485): Xaa can be any naturally occurring amino acid except Pro or Gly
  VARIANT (486)..(486): Xaa can be any naturally occurring amino acid except Pro or Gly
  VARIANT (488)..(488): Xaa can be any naturally occurring amino acid
  VARIANT (489)..(489): Xaa can be any naturally occurring amino acid
  VARIANT (490)..(490): Xaa can be any naturally occurring amino acid
  VARIANT (492)..(492): Xaa can be any naturally occurring amino acid except Pro or Gly
  VARIANT (493)..(493): Xaa can be any naturally occurring amino acid except Pro or Gly
  VARIANT (494)..(494): Xaa can be any naturally occurring amino acid except Pro or Gly
  VARIANT (496)..(496): Xaa can be any naturally occurring amino acid
  VARIANT (497)..(497): Xaa can be any naturally occurring amino acid
  VARIANT (498)..(498): Xaa can be any naturally occurring amino acid
  VARIANT (500)..(500): Xaa can be any naturally occurring amino acid except Pro or Gly
  VARIANT (501)..(501): Xaa can be any naturally occurring amino acid except Pro or Gly
  VARIANT (502)..(502): Xaa can be any naturally occurring amino acid except Pro or Gly
  VARIANT (504)..(504): Xaa can be any naturally occurring amino acid
  VARIANT (505)..(505): Xaa can be any naturally occurring amino acid
  VARIANT (506)..(506): Xaa can be any naturally occurring amino acid
  VARIANT (508)..(508): Xaa can be any naturally occurring amino acid except Pro or Gly
  VARIANT (509)..(509): Xaa can be any naturally occurring amino acid except Pro or Gly
  VARIANT (510)..(510): Xaa can be any naturally occurring amino acid except Pro or Gly
  VARIANT (512)..(512): Xaa can be any naturally occurring amino acid
  VARIANT (513)..(513): Xaa can be any naturally occurring amino acid
  VARIANT (514)..(514): Xaa can be any naturally occurring amino acid
  VARIANT (516)..(516): Xaa can be any naturally occurring amino acid except Pro or Gly
  VARIANT (517)..(517): Xaa can be any naturally occurring amino acid except Pro or Gly
  VARIANT (518)..(518): Xaa can be any naturally occurring amino acid except Pro or Gly
  VARIANT (520)..(520): Xaa can be any naturally occurring amino acid
  VARIANT (521)..(521): Xaa can be any naturally occurring amino acid
  VARIANT (522)..(522): Xaa can be any naturally occurring amino acid
  VARIANT (524)..(524): Xaa can be any naturally occurring amino acid except Pro or Gly
  VARIANT (525)..(525): Xaa can be any naturally occurring amino acid except Pro or Gly
  VARIANT (526)..(526): Xaa can be any naturally occurring amino acid except Pro or Gly
  VARIANT (528)..(528): Xaa can be any naturally occurring amino acid
  VARIANT (529)..(529): Xaa can be any naturally occurring amino acid
  VARIANT (530)..(530): Xaa can be any naturally occurring amino acid
  VARIANT (532)..(532): Xaa can be any naturally occurring amino acid except Pro or Gly
  VARIANT (533)..(533): Xaa can be any naturally occurring amino acid except Pro or Gly
  VARIANT (534)..(534): Xaa can be any naturally occurring amino acid except Pro or Gly
  VARIANT (536)..(536): Xaa can be any naturally occurring amino acid
  VARIANT (537)..(537): Xaa can be any naturally occurring amino acid
  VARIANT (538)..(538): Xaa can be any naturally occurring amino acid
  VARIANT (540)..(540): Xaa can be any naturally occurring amino acid except Pro or Gly
  VARIANT (541)..(541): Xaa can be any naturally occurring amino acid except Pro or Gly
  VARIANT (542)..(542): Xaa can be any naturally occurring amino acid except Pro or Gly
  VARIANT (544)..(544): Xaa can be any naturally occurring amino acid
  VARIANT (545)..(545): Xaa can be any naturally occurring amino acid
  VARIANT (546)..(546): Xaa can be any naturally occurring amino acid
  VARIANT (548)..(548): Xaa can be any naturally occurring amino acid except Pro or Gly
  VARIANT (549)..(549): Xaa can be any naturally occurring amino acid except Pro or Gly
  VARIANT (550)..(550): Xaa can be any naturally occurring amino acid except Pro or Gly
  VARIANT (552)..(552): Xaa can be any naturally occurring amino acid
  VARIANT (553)..(553): Xaa can be any naturally occurring amino acid
  VARIANT (554)..(554): Xaa can be any naturally occurring amino acid
  VARIANT (556)..(556): Xaa can be any naturally occurring amino acid except Pro or Gly
  VARIANT (557)..(557): Xaa can be any naturally occurring amino acid except Pro or Gly
  VARIANT (558)..(558): Xaa can be any naturally occurring amino acid except Pro or Gly
  VARIANT (560)..(560): Xaa can be any naturally occurring amino acid
  VARIANT (561)..(561): Xaa can be any naturally occurring amino acid
  VARIANT (562)..(562): Xaa can be any naturally occurring amino acid
  VARIANT (564)..(564): Xaa can be any naturally occurring amino acid except Pro or Gly
  VARIANT (565)..(565): Xaa can be any naturally occurring amino acid except Pro or Gly
  VARIANT (566)..(566): Xaa can be any naturally occurring amino acid except Pro or Gly
  VARIANT (568)..(568): Xaa can be any naturally occurring amino acid
  VARIANT (569)..(569): Xaa can be any naturally occurring amino acid
  VARIANT (570)..(570): Xaa can be any naturally occurring amino acid
  VARIANT (572)..(572): Xaa can be any naturally occurring amino acid except Pro or Gly
  VARIANT (573)..(573): Xaa can be any naturally occurring amino acid except Pro or Gly
  VARIANT (574)..(574): Xaa can be any naturally occurring amino acid except Pro or Gly
  VARIANT (576)..(576): Xaa can be any naturally occurring amino acid
  VARIANT (577)..(577): Xaa can be any naturally occurring amino acid
  VARIANT (578)..(578): Xaa can be any naturally occurring amino acid
  VARIANT (580)..(580): Xaa can be any naturally occurring amino acid except Pro or Gly
  VARIANT (581)..(581): Xaa can be any naturally occurring amino acid except Pro or Gly
  VARIANT (582)..(582): Xaa can be any naturally occurring amino acid except Pro or Gly
  VARIANT (584)..(584): Xaa can be any naturally occurring amino acid
  VARIANT (585)..(585): Xaa can be any naturally occurring amino acid
  VARIANT (586)..(586): Xaa can be any naturally occurring amino acid
  VARIANT (588)..(588): Xaa can be any naturally occurring amino acid except Pro or Gly
  VARIANT (589)..(589): Xaa can be any naturally occurring amino acid except Pro or Gly
  VARIANT (590)..(590): Xaa can be any naturally occurring amino acid except Pro or Gly
  VARIANT (592)..(592): Xaa can be any naturally occurring amino acid
  VARIANT (593)..(593): Xaa can be any naturally occurring amino acid
  VARIANT (594)..(594): Xaa can be any naturally occurring amino acid
  VARIANT (596)..(596): Xaa can be any naturally occurring amino acid except Pro or Gly
  VARIANT (597)..(597): Xaa can be any naturally occurring amino acid except Pro or Gly
  VARIANT (598)..(598): Xaa can be any naturally occurring amino acid except Pro or Gly
  VARIANT (600)..(600): Xaa can be any naturally occurring amino acid
  VARIANT (601)..(601): Xaa can be any naturally occurring amino acid
  VARIANT (602)..(602): Xaa can be any naturally occurring amino acid
  VARIANT (604)..(604): Xaa can be any naturally occurring amino acid except Pro or Gly
  VARIANT (605)..(605): Xaa can be any naturally occurring amino acid except Pro or Gly
  VARIANT (606)..(606): Xaa can be any naturally occurring amino acid except Pro or Gly
  VARIANT (608)..(608): Xaa can be any naturally occurring amino acid
  VARIANT (609)..(609): Xaa can be any naturally occurring amino acid
  VARIANT (610)..(610): Xaa can be any naturally occurring amino acid
  VARIANT (612)..(612): Xaa can be any naturally occurring amino acid except Pro or Gly
  VARIANT (613)..(613): Xaa can be any naturally occurring amino acid except Pro or Gly
  VARIANT (614)..(614): Xaa can be any naturally occurring amino acid except Pro or Gly
  VARIANT (616)..(616): Xaa can be any naturally occurring amino acid
  VARIANT (617)..(617): Xaa can be any naturally occurring amino acid
  VARIANT (618)..(618): Xaa can be any naturally occurring amino acid
  VARIANT (620)..(620): Xaa can be any naturally occurring amino acid except Pro or Gly
  VARIANT (621)..(621): Xaa can be any naturally occurring amino acid except Pro or Gly
  VARIANT (622)..(622): Xaa can be any naturally occurring amino acid except Pro or Gly
  VARIANT (624)..(624): Xaa can be any naturally occurring amino acid
  VARIANT (625)..(625): Xaa can be any naturally occurring amino acid
  VARIANT (626)..(626): Xaa can be any naturally occurring amino acid
  VARIANT (628)..(628): Xaa can be any naturally occurring amino acid except Pro or Gly
  VARIANT (629)..(629): Xaa can be any naturally occurring amino acid except Pro or Gly
  VARIANT (630)..(630): Xaa can be any naturally occurring amino acid except Pro or Gly
  VARIANT (632)..(632): Xaa can be any naturally occurring amino acid
  VARIANT (633)..(633): Xaa can be any naturally occurring amino acid
  VARIANT (634)..(634): Xaa can be any naturally occurring amino acid
  VARIANT (636)..(636): Xaa can be any naturally occurring amino acid except Pro or Gly
  VARIANT (637)..(637): Xaa can be any naturally occurring amino acid except Pro or Gly
  VARIANT (638)..(638): Xaa can be any naturally occurring amino acid except Pro or Gly
  VARIANT (640)..(640): Xaa can be any naturally occurring amino acid
  VARIANT (641)..(641): Xaa can be any naturally occurring amino acid
  VARIANT (642)..(642): Xaa can be any naturally occurring amino acid
  VARIANT (644)..(644): Xaa can be any naturally occurring amino acid except Pro or Gly
  VARIANT (645)..(645): Xaa can be any naturally occurring amino acid except Pro or Gly
  VARIANT (646)..(646): Xaa can be any naturally occurring amino acid except Pro or Gly
  VARIANT (648)..(648): Xaa can be any naturally occurring amino acid
  VARIANT (649)..(649): Xaa can be any naturally occurring amino acid
  VARIANT (650)..(650): Xaa can be any naturally occurring amino acid
  VARIANT (652)..(652): Xaa can be any naturally occurring amino acid except Pro or Gly
  VARIANT (653)..(653): Xaa can be any naturally occurring amino acid except Pro or Gly
  VARIANT (654)..(654): Xaa can be any naturally occurring amino acid except Pro or Gly
  VARIANT (656)..(656): Xaa can be any naturally occurring amino acid
  VARIANT (657)..(657): Xaa can be any naturally occurring amino acid
  VARIANT (658)..(658): Xaa can be any naturally occurring amino acid
  VARIANT (660)..(660): Xaa can be any naturally occurring amino acid except Pro or Gly
  VARIANT (661)..(661): Xaa can be any naturally occurring amino acid except Pro or Gly
  VARIANT (662)..(662): Xaa can be any naturally occurring amino acid except Pro or Gly
  VARIANT (664)..(664): Xaa can be any naturally occurring amino acid
  VARIANT (665)..(665): Xaa can be any naturally occurring amino acid
  VARIANT (666)..(666): Xaa can be any naturally occurring amino acid
  VARIANT (668)..(668): Xaa can be any naturally occurring amino acid except Pro or Gly
  VARIANT (669)..(669): Xaa can be any naturally occurring amino acid except Pro or Gly
  VARIANT (670)..(670): Xaa can be any naturally occurring amino acid except Pro or Gly
  VARIANT (672)..(672): Xaa can be any naturally occurring amino acid
  VARIANT (673)..(673): Xaa can be any naturally occurring amino acid
  VARIANT (674)..(674): Xaa can be any naturally occurring amino acid
  VARIANT (676)..(676): Xaa can be any naturally occurring amino acid except Pro or Gly
  VARIANT (677)..(677): Xaa can be any naturally occurring amino acid except Pro or Gly
  VARIANT (678)..(678): Xaa can be any naturally occurring amino acid except Pro or Gly
  VARIANT (680)..(680): Xaa can be any naturally occurring amino acid
  VARIANT (681)..(681): Xaa can be any naturally occurring amino acid
  VARIANT (682)..(682): Xaa can be any naturally occurring amino acid
  VARIANT (684)..(684): Xaa can be any naturally occurring amino acid except Pro or Gly
  VARIANT (685)..(685): Xaa can be any naturally occurring amino acid except Pro or Gly
  VARIANT (686)..(686): Xaa can be any naturally occurring amino acid except Pro or Gly
  VARIANT (688)..(688): Xaa can be any naturally occurring amino acid
  VARIANT (689)..(689): Xaa can be any naturally occurring amino acid
  VARIANT (690)..(690): Xaa can be any naturally occurring amino acid
  VARIANT (692)..(692): Xaa can be any naturally occurring amino acid except Pro or Gly
  VARIANT (693)..(693): Xaa can be any naturally occurring amino acid except Pro or Gly
  VARIANT (694)..(694): Xaa can be any naturally occurring amino acid except Pro or Gly
  VARIANT (696)..(696): Xaa can be any naturally occurring amino acid
  VARIANT (697)..(697): Xaa can be any naturally occurring amino acid
  VARIANT (698)..(698): Xaa can be any naturally occurring amino acid
  VARIANT (700)..(700): Xaa can be any naturally occurring amino acid except Pro or Gly
  VARIANT (701)..(701): Xaa can be any naturally occurring amino acid except Pro or Gly
  VARIANT (702)..(702): Xaa can be any naturally occurring amino acid except Pro or Gly
  VARIANT (704)..(704): Xaa can be any naturally occurring amino acid
  VARIANT (705)..(705): Xaa can be any naturally occurring amino acid
  VARIANT (706)..(706): Xaa can be any naturally occurring amino acid
  VARIANT (708)..(708): Xaa can be any naturally occurring amino acid except Pro or Gly
  VARIANT (709)..(709): Xaa can be any naturally occurring amino acid except Pro or Gly
  VARIANT (710)..(710): Xaa can be any naturally occurring amino acid except Pro or Gly
  VARIANT (712)..(712): Xaa can be any naturally occurring amino acid
  VARIANT (713)..(713): Xaa can be any naturally occurring amino acid
  VARIANT (714)..(714): Xaa can be any naturally occurring amino acid
  VARIANT (716)..(716): Xaa can be any naturally occurring amino acid except Pro or Gly
  VARIANT (717)..(717): Xaa can be any naturally occurring amino acid except Pro or Gly
  VARIANT (718)..(718): Xaa can be any naturally occurring amino acid except Pro or Gly
  VARIANT (720)..(720): Xaa can be any naturally occurring amino acid
  VARIANT (721)..(721): Xaa can be any naturally occurring amino acid
  VARIANT (722)..(722): Xaa can be any naturally occurring amino acid
  VARIANT (724)..(724): Xaa can be any naturally occurring amino acid except Pro or Gly
  VARIANT (725)..(725): Xaa can be any naturally occurring amino acid except Pro or Gly
  VARIANT (726)..(726): Xaa can be any naturally occurring amino acid except Pro or Gly
  VARIANT (728)..(728): Xaa can be any naturally occurring amino acid
  VARIANT (729)..(729): Xaa can be any naturally occurring amino acid
  VARIANT (730)..(730): Xaa can be any naturally occurring amino acid
  VARIANT (732)..(732): Xaa can be any naturally occurring amino acid except Pro or Gly
  VARIANT (733)..(733): Xaa can be any naturally occurring amino acid except Pro or Gly
  VARIANT (734)..(734): Xaa can be any naturally occurring amino acid except Pro or Gly
  VARIANT (736)..(736): Xaa can be any naturally occurring amino acid
  VARIANT (737)..(737): Xaa can be any naturally occurring amino acid
  VARIANT (738)..(738): Xaa can be any naturally occurring amino acid
  VARIANT (740)..(740): Xaa can be any naturally occurring amino acid except Pro or Gly
  VARIANT (741)..(741): Xaa can be any naturally occurring amino acid except Pro or Gly
  VARIANT (742)..(742): Xaa can be any naturally occurring amino acid except Pro or Gly
  VARIANT (744)..(744): Xaa can be any naturally occurring amino acid
  VARIANT (745)..(745): Xaa can be any naturally occurring amino acid
  VARIANT (746)..(746): Xaa can be any naturally occurring amino acid
  VARIANT (748)..(748): Xaa can be any naturally occurring amino acid except Pro or Gly
  VARIANT (749)..(749): Xaa can be any naturally occurring amino acid except Pro or Gly
  VARIANT (750)..(750): Xaa can be any naturally occurring amino acid except Pro or Gly
  VARIANT (752)..(752): Xaa can be any naturally occurring amino acid
  VARIANT (753)..(753): Xaa can be any naturally occurring amino acid
  VARIANT (754)..(754): Xaa can be any naturally occurring amino acid
  VARIANT (756)..(756): Xaa can be any naturally occurring amino acid except Pro or Gly
  VARIANT (757)..(757): Xaa can be any naturally occurring amino acid except Pro or Gly
  VARIANT (758)..(758): Xaa can be any naturally occurring amino acid except Pro or Gly
  VARIANT (760)..(760): Xaa can be any naturally occurring amino acid
  VARIANT (761)..(761): Xaa can be any naturally occurring amino acid
  VARIANT (762)..(762): Xaa can be any naturally occurring amino acid
  VARIANT (764)..(764): Xaa can be any naturally occurring amino acid except Pro or Gly
  VARIANT (765)..(765): Xaa can be any naturally occurring amino acid except Pro or Gly
  VARIANT (766)..(766): Xaa can be any naturally occurring amino acid except Pro or Gly
  VARIANT (768)..(768): Xaa can be any naturally occurring amino acid
  VARIANT (769)..(769): Xaa can be any naturally occurring amino acid
  VARIANT (770)..(770): Xaa can be any naturally occurring amino acid
  VARIANT (772)..(772): Xaa can be any naturally occurring amino acid except Pro or Gly
  VARIANT (773)..(773): Xaa can be any naturally occurring amino acid except Pro or Gly
  VARIANT (774)..(774): Xaa can be any naturally occurring amino acid except Pro or Gly
  VARIANT (776)..(776): Xaa can be any naturally occurring amino acid
  VARIANT (777)..(777): Xaa can be any naturally occurring amino acid
  VARIANT (778)..(778): Xaa can be any naturally occurring amino acid
  VARIANT (780)..(780): Xaa can be any naturally occurring amino acid except Pro or Gly
  VARIANT (781)..(781): Xaa can be any naturally occurring amino acid except Pro or Gly
  VARIANT (782)..(782): Xaa can be any naturally occurring amino acid except Pro or Gly
  VARIANT (784)..(784): Xaa can be any naturally occurring amino acid
  VARIANT (785)..(785): Xaa can be any naturally occurring amino acid
  VARIANT (786)..(786): Xaa can be any naturally occurring amino acid
  VARIANT (788)..(788): Xaa can be any naturally occurring amino acid except Pro or Gly
  VARIANT (789)..(789): Xaa can be any naturally occurring amino acid except Pro or Gly
  VARIANT (790)..(790): Xaa can be any naturally occurring amino acid except Pro or Gly
  VARIANT (792)..(792): Xaa can be any naturally occurring amino acid
  VARIANT (793)..(793): Xaa can be any naturally occurring amino acid
  VARIANT (794)..(794): Xaa can be any naturally occurring amino acid
  VARIANT (796)..(796): Xaa can be any naturally occurring amino acid except Pro or Gly
  VARIANT (797)..(797): Xaa can be any naturally occurring amino acid except Pro or Gly
  VARIANT (798)..(798): Xaa can be any naturally occurring amino acid except Pro or Gly
  VARIANT (800)..(800): Xaa can be any naturally occurring amino acid
  VARIANT (801)..(801): Xaa can be any naturally occurring amino acid
  VARIANT (802)..(802): Xaa can be any naturally occurring amino acid
  VARIANT (804)..(804): Xaa can be any naturally occurring amino acid except Pro or Gly
  VARIANT (805)..(805): Xaa can be any naturally occurring amino acid except Pro or Gly
  VARIANT (806)..(806): Xaa can be any naturally occurring amino acid except Pro or Gly
  VARIANT (808)..(808): Xaa can be any naturally occurring amino acid
  VARIANT (809)..(809): Xaa can be any naturally occurring amino acid
  VARIANT (810)..(810): Xaa can be any naturally occurring amino acid
  VARIANT (812)..(812): Xaa can be any naturally occurring amino acid except Pro or Gly
  VARIANT (813)..(813): Xaa can be any naturally occurring amino acid except Pro or Gly
  VARIANT (814)..(814): Xaa can be any naturally occurring amino acid except Pro or Gly
  VARIANT (816)..(816): Xaa can be any naturally occurring amino acid
  VARIANT (817)..(817): Xaa can be any naturally occurring amino acid
  VARIANT (818)..(818): Xaa can be any naturally occurring amino acid
  VARIANT (820)..(820): Xaa can be any naturally occurring amino acid except Pro or Gly
  VARIANT (821)..(821): Xaa can be any naturally occurring amino acid except Pro or Gly
  VARIANT (822)..(822): Xaa can be any naturally occurring amino acid except Pro or Gly
  VARIANT (824)..(824): Xaa can be any naturally occurring amino acid
  VARIANT (825)..(825): Xaa can be any naturally occurring amino acid
  VARIANT (826)..(826): Xaa can be any naturally occurring amino acid
  VARIANT (828)..(828): Xaa can be any naturally occurring amino acid except Pro or Gly
  VARIANT (829)..(829): Xaa can be any naturally occurring amino acid except Pro or Gly
  VARIANT (830)..(830): Xaa can be any naturally occurring amino acid except Pro or Gly
  VARIANT (832)..(832): Xaa can be any naturally occurring amino acid
  VARIANT (833)..(833): Xaa can be any naturally occurring amino acid
  VARIANT (834)..(834): Xaa can be any naturally occurring amino acid
  VARIANT (836)..(836): Xaa can be any naturally occurring amino acid except Pro or Gly
  VARIANT (837)..(837): Xaa can be any naturally occurring amino acid except Pro or Gly
  VARIANT (838)..(838): Xaa can be any naturally occurring amino acid except Pro or Gly
  VARIANT (840)..(840): Xaa can be any naturally occurring amino acid
  VARIANT (841)..(841): Xaa can be any naturally occurring amino acid
  VARIANT (842)..(842): Xaa can be any naturally occurring amino acid
  VARIANT (844)..(844): Xaa can be any naturally occurring amino acid except Pro or Gly
  VARIANT (845)..(845): Xaa can be any naturally occurring amino acid except Pro or Gly
  VARIANT (846)..(846): Xaa can be any naturally occurring amino acid except Pro or Gly
  VARIANT (848)..(848): Xaa can be any naturally occurring amino acid
  VARIANT (849)..(849): Xaa can be any naturally occurring amino acid
  VARIANT (850)..(850): Xaa can be any naturally occurring amino acid
  VARIANT (852)..(852): Xaa can be any naturally occurring amino acid except Pro or Gly
  VARIANT (853)..(853): Xaa can be any naturally occurring amino acid except Pro or Gly
  VARIANT (854)..(854): Xaa can be any naturally occurring amino acid except Pro or Gly
  VARIANT (856)..(856): Xaa can be any naturally occurring amino acid
  VARIANT (857)..(857): Xaa can be any naturally occurring amino acid
  VARIANT (858)..(858): Xaa can be any naturally occurring amino acid
  VARIANT (860)..(860): Xaa can be any naturally occurring amino acid except Pro or Gly
  VARIANT (861)..(861): Xaa can be any naturally occurring amino acid except Pro or Gly
  VARIANT (862)..(862): Xaa can be any naturally occurring amino acid except Pro or Gly
  VARIANT (864)..(864): Xaa can be any naturally occurring amino acid
  VARIANT (865)..(865): Xaa can be any naturally occurring amino acid
  VARIANT (866)..(866): Xaa can be any naturally occurring amino acid
  VARIANT (868)..(868): Xaa can be any naturally occurring amino acid except Pro or Gly
  VARIANT (869)..(869): Xaa can be any naturally occurring amino acid except Pro or Gly
  VARIANT (870)..(870): Xaa can be any naturally occurring amino acid except Pro or Gly
  VARIANT (872)..(872): Xaa can be any naturally occurring amino acid
  VARIANT (873)..(873): Xaa can be any naturally occurring amino acid
  VARIANT (874)..(874): Xaa can be any naturally occurring amino acid
  VARIANT (876)..(876): Xaa can be any naturally occurring amino acid except Pro or Gly
  VARIANT (877)..(877): Xaa can be any naturally occurring amino acid except Pro or Gly
  VARIANT (878)..(878): Xaa can be any naturally occurring amino acid except Pro or Gly
  VARIANT (880)..(880): Xaa can be any naturally occurring amino acid
  VARIANT (881)..(881): Xaa can be any naturally occurring amino acid
  VARIANT (882)..(882): Xaa can be any naturally occurring amino acid
  VARIANT (884)..(884): Xaa can be any naturally occurring amino acid except Pro or Gly
  VARIANT (885)..(885): Xaa can be any naturally occurring amino acid except Pro or Gly
  VARIANT (886)..(886): Xaa can be any naturally occurring amino acid except Pro or Gly
  VARIANT (888)..(888): Xaa can be any naturally occurring amino acid
  VARIANT (889)..(889): Xaa can be any naturally occurring amino acid
  VARIANT (890)..(890): Xaa can be any naturally occurring amino acid
  VARIANT (892)..(892): Xaa can be any naturally occurring amino acid except Pro or Gly
  VARIANT (893)..(893): Xaa can be any naturally occurring amino acid except Pro or Gly
  VARIANT (894)..(894): Xaa can be any naturally occurring amino acid except Pro or Gly
  VARIANT (896)..(896): Xaa can be any naturally occurring amino acid
  VARIANT (897)..(897): Xaa can be any naturally occurring amino acid
  VARIANT (898)..(898): Xaa can be any naturally occurring amino acid
  VARIANT (900)..(900): Xaa can be any naturally occurring amino acid except Pro or Gly
  VARIANT (901)..(901): Xaa can be any naturally occurring amino acid except Pro or Gly
  VARIANT (902)..(902): Xaa can be any naturally occurring amino acid except Pro or Gly
  VARIANT (904)..(904): Xaa can be any naturally occurring amino acid
  VARIANT (905)..(905): Xaa can be any naturally occurring amino acid
  VARIANT (906)..(906): Xaa can be any naturally occurring amino acid
  VARIANT (908)..(908): Xaa can be any naturally occurring amino acid except Pro or Gly
  VARIANT (909)..(909): Xaa can be any naturally occurring amino acid except Pro or Gly
  VARIANT (910)..(910): Xaa can be any naturally occurring amino acid except Pro or Gly
  VARIANT (912)..(912): Xaa can be any naturally occurring amino acid
  VARIANT (913)..(913): Xaa can be any naturally occurring amino acid
  VARIANT (914)..(914): Xaa can be any naturally occurring amino acid
  VARIANT (916)..(916): Xaa can be any naturally occurring amino acid except Pro or Gly
  VARIANT (917)..(917): Xaa can be any naturally occurring amino acid except Pro or Gly
  VARIANT (918)..(918): Xaa can be any naturally occurring amino acid except Pro or Gly
  VARIANT (920)..(920): Xaa can be any naturally occurring amino acid
  VARIANT (921)..(921): Xaa can be any naturally occurring amino acid
  VARIANT (922)..(922): Xaa can be any naturally occurring amino acid
  VARIANT (924)..(924): Xaa can be any naturally occurring amino acid except Pro or Gly
  VARIANT (925)..(925): Xaa can be any naturally occurring amino acid except Pro or Gly
  VARIANT (926)..(926): Xaa can be any naturally occurring amino acid except Pro or Gly
  VARIANT (928)..(928): Xaa can be any naturally occurring amino acid
  VARIANT (929)..(929): Xaa can be any naturally occurring amino acid
  VARIANT (930)..(930): Xaa can be any naturally occurring amino acid
  VARIANT (932)..(932): Xaa can be any naturally occurring amino acid except Pro or Gly
  VARIANT (933)..(933): Xaa can be any naturally occurring amino acid except Pro or Gly
  VARIANT (934)..(934): Xaa can be any naturally occurring amino acid except Pro or Gly
  VARIANT (936)..(936): Xaa can be any naturally occurring amino acid
  VARIANT (937)..(937): Xaa can be any naturally occurring amino acid
  VARIANT (938)..(938): Xaa can be any naturally occurring amino acid
  VARIANT (940)..(940): Xaa can be any naturally occurring amino acid except Pro or Gly
  VARIANT (941)..(941): Xaa can be any naturally occurring amino acid except Pro or Gly
  VARIANT (942)..(942): Xaa can be any naturally occurring amino acid except Pro or Gly
  VARIANT (944)..(944): Xaa can be any naturally occurring amino acid
  VARIANT (945)..(945): Xaa can be any naturally occurring amino acid
  VARIANT (946)..(946): Xaa can be any naturally occurring amino acid
  VARIANT (948)..(948): Xaa can be any naturally occurring amino acid except Pro or Gly
  VARIANT (949)..(949): Xaa can be any naturally occurring amino acid except Pro or Gly
  VARIANT (950)..(950): Xaa can be any naturally occurring amino acid except Pro or Gly
  VARIANT (952)..(952): Xaa can be any naturally occurring amino acid
  VARIANT (953)..(953): Xaa can be any naturally occurring amino acid
  VARIANT (954)..(954): Xaa can be any naturally occurring amino acid
  VARIANT (956)..(956): Xaa can be any naturally occurring amino acid except Pro or Gly
  VARIANT (957)..(957): Xaa can be any naturally occurring amino acid except Pro or Gly
  VARIANT (958)..(958): Xaa can be any naturally occurring amino acid except Pro or Gly
  VARIANT (960)..(960): Xaa can be any naturally occurring amino acid
  VARIANT (961)..(961): Xaa can be any naturally occurring amino acid
  VARIANT (962)..(962): Xaa can be any naturally occurring amino acid
  VARIANT (964)..(964): Xaa can be any naturally occurring amino acid except Pro or Gly
  VARIANT (965)..(965): Xaa can be any naturally occurring amino acid except Pro or Gly
  VARIANT (966)..(966): Xaa can be any naturally occurring amino acid except Pro or Gly
  VARIANT (968)..(968): Xaa can be any naturally occurring amino acid
  VARIANT (969)..(969): Xaa can be any naturally occurring amino acid
  VARIANT (970)..(970): Xaa can be any naturally occurring amino acid
  VARIANT (972)..(972): Xaa can be any naturally occurring amino acid except Pro or Gly
  VARIANT (973)..(973): Xaa can be any naturally occurring amino acid except Pro or Gly
  VARIANT (974)..(974): Xaa can be any naturally occurring amino acid except Pro or Gly
  VARIANT (976)..(976): Xaa can be any naturally occurring amino acid
  VARIANT (977)..(977): Xaa can be any naturally occurring amino acid
  VARIANT (978)..(978): Xaa can be any naturally occurring amino acid
  VARIANT (980)..(980): Xaa can be any naturally occurring amino acid except Pro or Gly
  VARIANT (981)..(981): Xaa can be any naturally occurring amino acid except Pro or Gly
  VARIANT (982)..(982): Xaa can be any naturally occurring amino acid except Pro or Gly
  VARIANT (984)..(984): Xaa can be any naturally occurring amino acid
  VARIANT (985)..(985): Xaa can be any naturally occurring amino acid
  VARIANT (986)..(986): Xaa can be any naturally occurring amino acid
  VARIANT (988)..(988): Xaa can be any naturally occurring amino acid except Pro or Gly
  VARIANT (989)..(989): Xaa can be any naturally occurring amino acid except Pro or Gly
  VARIANT (990)..(990): Xaa can be any naturally occurring amino acid except Pro or Gly
  VARIANT (992)..(992): Xaa can be any naturally occurring amino acid
  VARIANT (993)..(993): Xaa can be any naturally occurring amino acid
  VARIANT (994)..(994): Xaa can be any naturally occurring amino acid
  VARIANT (996)..(996): Xaa can be any naturally occurring amino acid except Pro or Gly
  VARIANT (997)..(997): Xaa can be any naturally occurring amino acid except Pro or Gly
  VARIANT (998)..(998): Xaa can be any naturally occurring amino acid except Pro or Gly
  VARIANT (1000)..(1000): Xaa can be any naturally occurring amino acid
  VARIANT (1001)..(1001): Xaa can be any naturally occurring amino acid
  VARIANT (1002)..(1002): Xaa can be any naturally occurring amino acid
  VARIANT (1004)..(1004): Xaa can be any naturally occurring amino acid except Pro or Gly
  VARIANT (1005)..(1005): Xaa can be any naturally occurring amino acid except Pro or Gly
  VARIANT (1006)..(1006): Xaa can be any naturally occurring amino acid except Pro or Gly
  VARIANT (1008)..(1008): Xaa can be any naturally occurring amino acid
  VARIANT (1009)..(1009): Xaa can be any naturally occurring amino acid
  VARIANT (1010)..(1010): Xaa can be any naturally occurring amino acid
  VARIANT (1012)..(1012): Xaa can be any naturally occurring amino acid except Pro or Gly
  VARIANT (1013)..(1013): Xaa can be any naturally occurring amino acid except Pro or Gly
  VARIANT (1014)..(1014): Xaa can be any naturally occurring amino acid except Pro or Gly
  VARIANT (1016)..(1016): Xaa can be any naturally occurring amino acid
  VARIANT (1017)..(1017): Xaa can be any naturally occurring amino acid
  VARIANT (1018)..(1018): Xaa can be any naturally occurring amino acid
  VARIANT (1020)..(1020): Xaa can be any naturally occurring amino acid except Pro or Gly
  VARIANT (1021)..(1021): Xaa can be any naturally occurring amino acid except Pro or Gly
  VARIANT (1022)..(1022): Xaa can be any naturally occurring amino acid except Pro or Gly
  VARIANT (1024)..(1024): Xaa can be any naturally occurring amino acid
  VARIANT (1025)..(1025): Xaa can be any naturally occurring amino acid
  VARIANT (1026)..(1026): Xaa can be any naturally occurring amino acid
  VARIANT (1028)..(1028): Xaa can be any naturally occurring amino acid except Pro or Gly
  VARIANT (1029)..(1029): Xaa can be any naturally occurring amino acid except Pro or Gly
  VARIANT (1030)..(1030): Xaa can be any naturally occurring amino acid except Pro or Gly
  VARIANT (1032)..(1032): Xaa can be any naturally occurring amino acid
  VARIANT (1033)..(1033): Xaa can be any naturally occurring amino acid
  VARIANT (1034)..(1034): Xaa can be any naturally occurring amino acid
  VARIANT (1036)..(1036): Xaa can be any naturally occurring amino acid except Pro or Gly
  VARIANT (1037)..(1037): Xaa can be any naturally occurring amino acid except Pro or Gly
  VARIANT (1038)..(1038): Xaa can be any naturally occurring amino acid except Pro or Gly
  VARIANT (1040)..(1040): Xaa can be any naturally occurring amino acid
  VARIANT (1041)..(1041): Xaa can be any naturally occurring amino acid
  VARIANT (1042)..(1042): Xaa can be any naturally occurring amino acid
  VARIANT (1044)..(1044): Xaa can be any naturally occurring amino acid except Pro or Gly
  VARIANT (1045)..(1045): Xaa can be any naturally occurring amino acid except Pro or Gly
  VARIANT (1046)..(1046): Xaa can be any naturally occurring amino acid except Pro or Gly
  VARIANT (1048)..(1048): Xaa can be any naturally occurring amino acid
  VARIANT (1049)..(1049): Xaa can be any naturally occurring amino acid
  VARIANT (1050)..(1050): Xaa can be any naturally occurring amino acid
  VARIANT (1052)..(1052): Xaa can be any naturally occurring amino acid except Pro or Gly
  VARIANT (1053)..(1053): Xaa can be any naturally occurring amino acid except Pro or Gly
  VARIANT (1054)..(1054): Xaa can be any naturally occurring amino acid except Pro or Gly
  VARIANT (1056)..(1056): Xaa can be any naturally occurring amino acid
  VARIANT (1057)..(1057): Xaa can be any naturally occurring amino acid
  VARIANT (1058)..(1058): Xaa can be any naturally occurring amino acid
  VARIANT (1060)..(1060): Xaa can be any naturally occurring amino acid except Pro or Gly
  VARIANT (1061)..(1061): Xaa can be any naturally occurring amino acid except Pro or Gly
  VARIANT (1062)..(1062): Xaa can be any naturally occurring amino acid except Pro or Gly
  VARIANT (1064)..(1064): Xaa can be any naturally occurring amino acid
  VARIANT (1065)..(1065): Xaa can be any naturally occurring amino acid
  VARIANT (1066)..(1066): Xaa can be any naturally occurring amino acid
  VARIANT (1068)..(1068): Xaa can be any naturally occurring amino acid except Pro or Gly
  VARIANT (1069)..(1069): Xaa can be any naturally occurring amino acid except Pro or Gly
  VARIANT (1070)..(1070): Xaa can be any naturally occurring amino acid except Pro or Gly
  VARIANT (1072)..(1072): Xaa can be any naturally occurring amino acid
  VARIANT (1073)..(1073): Xaa can be any naturally occurring amino acid
  VARIANT (1074)..(1074): Xaa can be any naturally occurring amino acid
  VARIANT (1076)..(1076): Xaa can be any naturally occurring amino acid except Pro or Gly
  VARIANT (1077)..(1077): Xaa can be any naturally occurring amino acid except Pro or Gly
  VARIANT (1078)..(1078): Xaa can be any naturally occurring amino acid except Pro or Gly
  VARIANT (1080)..(1080): Xaa can be any naturally occurring amino acid
  VARIANT (1081)..(1081): Xaa can be any naturally occurring amino acid
  VARIANT (1082)..(1082): Xaa can be any naturally occurring amino acid
  VARIANT (1084)..(1084): Xaa can be any naturally occurring amino acid except Pro or Gly
  VARIANT (1085)..(1085): Xaa can be any naturally occurring amino acid except Pro or Gly
  VARIANT (1086)..(1086): Xaa can be any naturally occurring amino acid except Pro or Gly
  VARIANT (1088)..(1088): Xaa can be any naturally occurring amino acid
  VARIANT (1089)..(1089): Xaa can be any naturally occurring amino acid
  VARIANT (1090)..(1090): Xaa can be any naturally occurring amino acid
  VARIANT (1092)..(1092): Xaa can be any naturally occurring amino acid except Pro or Gly
  VARIANT (1093)..(1093): Xaa can be any naturally occurring amino acid except Pro or Gly
  VARIANT (1094)..(1094): Xaa can be any naturally occurring amino acid except Pro or Gly
  VARIANT (1096)..(1096): Xaa can be any naturally occurring amino acid
  VARIANT (1097)..(1097): Xaa can be any naturally occurring amino acid
  VARIANT (1098)..(1098): Xaa can be any naturally occurring amino acid
  VARIANT (1100)..(1100): Xaa can be any naturally occurring amino acid except Pro or Gly
  VARIANT (1101)..(1101): Xaa can be any naturally occurring amino acid except Pro or Gly
  VARIANT (1102)..(1102): Xaa can be any naturally occurring amino acid except Pro or Gly
  VARIANT (1104)..(1104): Xaa can be any naturally occurring amino acid
  VARIANT (1105)..(1105): Xaa can be any naturally occurring amino acid
  VARIANT (1106)..(1106): Xaa can be any naturally occurring amino acid
  VARIANT (1108)..(1108): Xaa can be any naturally occurring amino acid except Pro or Gly
  VARIANT (1109)..(1109): Xaa can be any naturally occurring amino acid except Pro or Gly
  VARIANT (1110)..(1110): Xaa can be any naturally occurring amino acid except Pro or Gly
  VARIANT (1112)..(1112): Xaa can be any naturally occurring amino acid
  VARIANT (1113)..(1113): Xaa can be any naturally occurring amino acid
  VARIANT (1114)..(1114): Xaa can be any naturally occurring amino acid
  VARIANT (1116)..(1116): Xaa can be any naturally occurring amino acid except Pro or Gly
  VARIANT (1117)..(1117): Xaa can be any naturally occurring amino acid except Pro or Gly
  VARIANT (1118)..(1118): Xaa can be any naturally occurring amino acid except Pro or Gly
  VARIANT (1120)..(1120): Xaa can be any naturally occurring amino acid
  VARIANT (1121)..(1121): Xaa can be any naturally occurring amino acid
  VARIANT (1122)..(1122): Xaa can be any naturally occurring amino acid
  VARIANT (1124)..(1124): Xaa can be any naturally occurring amino acid except Pro or Gly
  VARIANT (1125)..(1125): Xaa can be any naturally occurring amino acid except Pro or Gly
  VARIANT (1126)..(1126): Xaa can be any naturally occurring amino acid except Pro or Gly
  VARIANT (1128)..(1128): Xaa can be any naturally occurring amino acid
  VARIANT (1129)..(1129): Xaa can be any naturally occurring amino acid
  VARIANT (1130)..(1130): Xaa can be any naturally occurring amino acid
  VARIANT (1132)..(1132): Xaa can be any naturally occurring amino acid except Pro or Gly
  VARIANT (1133)..(1133): Xaa can be any naturally occurring amino acid except Pro or Gly
  VARIANT (1134)..(1134): Xaa can be any naturally occurring amino acid except Pro or Gly
  VARIANT (1136)..(1136): Xaa can be any naturally occurring amino acid
  VARIANT (1137)..(1137): Xaa can be any naturally occurring amino acid
  VARIANT (1138)..(1138): Xaa can be any naturally occurring amino acid
  VARIANT (1140)..(1140): Xaa can be any naturally occurring amino acid except Pro or Gly
  VARIANT (1141)..(1141): Xaa can be any naturally occurring amino acid except Pro or Gly
  VARIANT (1142)..(1142): Xaa can be any naturally occurring amino acid except Pro or Gly
  VARIANT (1144)..(1144): Xaa can be any naturally occurring amino acid
  VARIANT (1145)..(1145): Xaa can be any naturally occurring amino acid
  VARIANT (1146)..(1146): Xaa can be any naturally occurring amino acid
  VARIANT (1148)..(1148): Xaa can be any naturally occurring amino acid except Pro or Gly
  VARIANT (1149)..(1149): Xaa can be any naturally occurring amino acid except Pro or Gly
  VARIANT (1150)..(1150): Xaa can be any naturally occurring amino acid except Pro or Gly
  VARIANT (1152)..(1152): Xaa can be any naturally occurring amino acid
  VARIANT (1153)..(1153): Xaa can be any naturally occurring amino acid
  VARIANT (1154)..(1154): Xaa can be any naturally occurring amino acid
  VARIANT (1156)..(1156): Xaa can be any naturally occurring amino acid except Pro or Gly
  VARIANT (1157)..(1157): Xaa can be any naturally occurring amino acid except Pro or Gly
  VARIANT (1158)..(1158): Xaa can be any naturally occurring amino acid except Pro or Gly
  VARIANT (1160)..(1160): Xaa can be any naturally occurring amino acid
  VARIANT (1161)..(1161): Xaa can be any naturally occurring amino acid
  VARIANT (1162)..(1162): Xaa can be any naturally occurring amino acid
  VARIANT (1164)..(1164): Xaa can be any naturally occurring amino acid except Pro or Gly
  VARIANT (1165)..(1165): Xaa can be any naturally occurring amino acid except Pro or Gly
  VARIANT (1166)..(1166): Xaa can be any naturally occurring amino acid except Pro or Gly
  VARIANT (1168)..(1168): Xaa can be any naturally occurring amino acid
  VARIANT (1169)..(1169): Xaa can be any naturally occurring amino acid
  VARIANT (1170)..(1170): Xaa can be any naturally occurring amino acid
  VARIANT (1172)..(1172): Xaa can be any naturally occurring amino acid except Pro or Gly
  VARIANT (1173)..(1173): Xaa can be any naturally occurring amino acid except Pro or Gly
  VARIANT (1174)..(1174): Xaa can be any naturally occurring amino acid except Pro or Gly
  VARIANT (1176)..(1176): Xaa can be any naturally occurring amino acid
  VARIANT (1177)..(1177): Xaa can be any naturally occurring amino acid
  VARIANT (1178)..(1178): Xaa can be any naturally occurring amino acid
  VARIANT (1180)..(1180): Xaa can be any naturally occurring amino acid except Pro or Gly
  VARIANT (1181)..(1181): Xaa can be any naturally occurring amino acid except Pro or Gly
  VARIANT (1182)..(1182): Xaa can be any naturally occurring amino acid except Pro or Gly
  VARIANT (1184)..(1184): Xaa can be any naturally occurring amino acid
  VARIANT (1185)..(1185): Xaa can be any naturally occurring amino acid
  VARIANT (1186)..(1186): Xaa can be any naturally occurring amino acid
  VARIANT (1188)..(1188): Xaa can be any naturally occurring amino acid except Pro or Gly
  VARIANT (1189)..(1189): Xaa can be any naturally occurring amino acid except Pro or Gly
  VARIANT (1190)..(1190): Xaa can be any naturally occurring amino acid except Pro or Gly
  VARIANT (1192)..(1192): Xaa can be any naturally occurring amino acid
  VARIANT (1193)..(1193): Xaa can be any naturally occurring amino acid
  VARIANT (1194)..(1194): Xaa can be any naturally occurring amino acid
  VARIANT (1196)..(1196): Xaa can be any naturally occurring amino acid except Pro or Gly
  VARIANT (1197)..(1197): Xaa can be any naturally occurring amino acid except Pro or Gly
  VARIANT (1198)..(1198): Xaa can be any naturally occurring amino acid except Pro or Gly
  VARIANT (1200)..(1200): Xaa can be any naturally occurring amino acid
  VARIANT (1201)..(1201): Xaa can be any naturally occurring amino acid
  VARIANT (1202)..(1202): Xaa can be any naturally occurring amino acid
  VARIANT (1204)..(1204): Xaa can be any naturally occurring amino acid except Pro or Gly
  VARIANT (1205)..(1205): Xaa can be any naturally occurring amino acid except Pro or Gly
  VARIANT (1206)..(1206): Xaa can be any naturally occurring amino acid except Pro or Gly
  VARIANT (1208)..(1208): Xaa can be any naturally occurring amino acid
  VARIANT (1209)..(1209): Xaa can be any naturally occurring amino acid
  VARIANT (1210)..(1210): Xaa can be any naturally occurring amino acid
  VARIANT (1212)..(1212): Xaa can be any naturally occurring amino acid except Pro or Gly
  VARIANT (1213)..(1213): Xaa can be any naturally occurring amino acid except Pro or Gly
  VARIANT (1214)..(1214): Xaa can be any naturally occurring amino acid except Pro or Gly
  VARIANT (1216)..(1216): Xaa can be any naturally occurring amino acid
  VARIANT (1217)..(1217): Xaa can be any naturally occurring amino acid
  VARIANT (1218)..(1218): Xaa can be any naturally occurring amino acid
  VARIANT (1220)..(1220): Xaa can be any naturally occurring amino acid except Pro or Gly
  VARIANT (1221)..(1221): Xaa can be any naturally occurring amino acid except Pro or Gly
  VARIANT (1222)..(1222): Xaa can be any naturally occurring amino acid except Pro or Gly
  VARIANT (1224)..(1224): Xaa can be any naturally occurring amino acid
  VARIANT (1225)..(1225): Xaa can be any naturally occurring amino acid
  VARIANT (1226)..(1226): Xaa can be any naturally occurring amino acid
  VARIANT (1228)..(1228): Xaa can be any naturally occurring amino acid except Pro or Gly
  VARIANT (1229)..(1229): Xaa can be any naturally occurring amino acid except Pro or Gly
  VARIANT (1230)..(1230): Xaa can be any naturally occurring amino acid except Pro or Gly
  VARIANT (1232)..(1232): Xaa can be any naturally occurring amino acid
  VARIANT (1233)..(1233): Xaa can be any naturally occurring amino acid
  VARIANT (1234)..(1234): Xaa can be any naturally occurring amino acid
  VARIANT (1236)..(1236): Xaa can be any naturally occurring amino acid except Pro or Gly
  VARIANT (1237)..(1237): Xaa can be any naturally occurring amino acid except Pro or Gly
  VARIANT (1238)..(1238): Xaa can be any naturally occurring amino acid except Pro or Gly
  VARIANT (1240)..(1240): Xaa can be any naturally occurring amino acid
  VARIANT (1241)..(1241): Xaa can be any naturally occurring amino acid
  VARIANT (1242)..(1242): Xaa can be any naturally occurring amino acid
  VARIANT (1244)..(1244): Xaa can be any naturally occurring amino acid except Pro or Gly
  VARIANT (1245)..(1245): Xaa can be any naturally occurring amino acid except Pro or Gly
  VARIANT (1246)..(1246): Xaa can be any naturally occurring amino acid except Pro or Gly
  VARIANT (1248)..(1248): Xaa can be any naturally occurring amino acid
  VARIANT (1249)..(1249): Xaa can be any naturally occurring amino acid
  VARIANT (1250)..(1250): Xaa can be any naturally occurring amino acid
  VARIANT (1252)..(1252): Xaa can be any naturally occurring amino acid except Pro or Gly
  VARIANT (1253)..(1253): Xaa can be any naturally occurring amino acid except Pro or Gly
  VARIANT (1254)..(1254): Xaa can be any naturally occurring amino acid except Pro or Gly
  VARIANT (1256)..(1256): Xaa can be any naturally occurring amino acid
  VARIANT (1257)..(1257): Xaa can be any naturally occurring amino acid
  VARIANT (1258)..(1258): Xaa can be any naturally occurring amino acid
  VARIANT (1260)..(1260): Xaa can be any naturally occurring amino acid except Pro or Gly
  VARIANT (1261)..(1261): Xaa can be any naturally occurring amino acid except Pro or Gly
  VARIANT (1262)..(1262): Xaa can be any naturally occurring amino acid except Pro or Gly
  VARIANT (1264)..(1264): Xaa can be any naturally occurring amino acid
  VARIANT (1265)..(1265): Xaa can be any naturally occurring amino acid
  VARIANT (1266)..(1266): Xaa can be any naturally occurring amino acid
  VARIANT (1268)..(1268): Xaa can be any naturally occurring amino acid except Pro or Gly
  VARIANT (1269)..(1269): Xaa can be any naturally occurring amino acid except Pro or Gly
  VARIANT (1270)..(1270): Xaa can be any naturally occurring amino acid except Pro or Gly
  VARIANT (1272)..(1272): Xaa can be any naturally occurring amino acid
  VARIANT (1273)..(1273): Xaa can be any naturally occurring amino acid
  VARIANT (1274)..(1274): Xaa can be any naturally occurring amino acid
  VARIANT (1276)..(1276): Xaa can be any naturally occurring amino acid except Pro or Gly
  VARIANT (1277)..(1277): Xaa can be any naturally occurring amino acid except Pro or Gly
  VARIANT (1278)..(1278): Xaa can be any naturally occurring amino acid except Pro or Gly
  VARIANT (1280)..(1280): Xaa can be any naturally occurring amino acid
XXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGX

SEQ ID NO: 152 - protein, 1280 aa, Artificial Sequence
  elastin-like polypeptide
  VARIANT (5)..(5): Xaa is Gln or Ser
  VARIANT (7)..(7): Xaa is Tyr or Val
  VARIANT (8)..(8): Xaa is Gln or Ser
  VARIANT (13)..(13): Xaa is Gln or Ser
  VARIANT (15)..(15): Xaa is Tyr or Val
  VARIANT (16)..(16): Xaa is Gln or Ser
  VARIANT (21)..(21): Xaa is Gln or Ser
  VARIANT (23)..(23): Xaa is Tyr or Val
  VARIANT (24)..(24): Xaa is Gln or Ser
  VARIANT (29)..(29): Xaa is Gln or Ser
  VARIANT (31)..(31): Xaa is Tyr or Val
  VARIANT (32)..(32): Xaa is Gln or Ser
  VARIANT (37)..(37): Xaa is Gln or Ser
  VARIANT (39)..(39): Xaa is Tyr or Val
  VARIANT (40)..(40): Xaa is Gln or Ser
  VARIANT (45)..(45): Xaa is Gln or Ser
  VARIANT (47)..(47): Xaa is Tyr or Val
  VARIANT (48)..(48): Xaa is Gln or Ser
  VARIANT (53)..(53): Xaa is Gln or Ser
  VARIANT (55)..(55): Xaa is Tyr or Val
  VARIANT (56)..(56): Xaa is Gln or Ser
  VARIANT (61)..(61): Xaa is Gln or Ser
  VARIANT (63)..(63): Xaa is Tyr or Val
  VARIANT (64)..(64): Xaa is Gln or Ser
  VARIANT (69)..(69): Xaa is Gln or Ser
  VARIANT (71)..(71): Xaa is Tyr or Val
  VARIANT (72)..(72): Xaa is Gln or Ser
  VARIANT (77)..(77): Xaa is Gln or Ser
  VARIANT (79)..(79): Xaa is Tyr or Val
  VARIANT (80)..(80): Xaa is Gln or Ser
  VARIANT (81)..(1280): May be present or absent in groups of the repeat unit Gly Arg Gly Asp Xaa Pro Xaa Xaa
  VARIANT (85)..(85): Xaa is Gln or Ser
  VARIANT (87)..(87): Xaa is Tyr or Val
  VARIANT (88)..(88): Xaa is Gln or Ser
  VARIANT (93)..(93): Xaa is Gln or Ser
  VARIANT (95)..(95): Xaa is Tyr or Val
  VARIANT (96)..(96): Xaa is Gln or Ser
  VARIANT (101)..(101): Xaa is Gln or Ser
  VARIANT (103)..(103): Xaa is Tyr or Val
  VARIANT (104)..(104): Xaa is Gln or Ser
  VARIANT (109)..(109): Xaa is Gln or Ser
  VARIANT (111)..(111): Xaa is Tyr or Val
  VARIANT (112)..(112): Xaa is Gln or Ser
  VARIANT (117)..(117): Xaa is Gln or Ser
  VARIANT (119)..(119): Xaa is Tyr or Val
  VARIANT (120)..(120): Xaa is Gln or Ser
  VARIANT (125)..(125): Xaa is Gln or Ser
  VARIANT (127)..(127): Xaa is Tyr or Val
  VARIANT (128)..(128): Xaa is Gln or Ser
  VARIANT (133)..(133): Xaa is Gln or Ser
  VARIANT (135)..(135): Xaa is Tyr or Val
  VARIANT (136)..(136): Xaa is Gln or Ser
  VARIANT (141)..(141): Xaa is Gln or Ser
  VARIANT (143)..(143): Xaa is Tyr or Val
  VARIANT (144)..(144): Xaa is Gln or Ser
  VARIANT (149)..(149): Xaa is Gln or Ser
  VARIANT (151)..(151): Xaa is Tyr or Val
  VARIANT (152)..(152): Xaa is Gln or Ser
  VARIANT (157)..(157): Xaa is Gln or Ser
  VARIANT (159)..(159): Xaa is Tyr or Val
  VARIANT (160)..(160): Xaa is Gln or Ser
  VARIANT (165)..(165): Xaa is Gln or Ser
  VARIANT (167)..(167): Xaa is Tyr or Val
  VARIANT (168)..(168): Xaa is Gln or Ser
  VARIANT (173)..(173): Xaa is Gln or Ser
  VARIANT (175)..(175): Xaa is Tyr or Val
  VARIANT (176)..(176): Xaa is Gln or Ser
  VARIANT (181)..(181): Xaa is Gln or Ser
  VARIANT (183)..(183): Xaa is Tyr or Val
  VARIANT (184)..(184): Xaa is Gln or Ser
  VARIANT (189)..(189): Xaa is Gln or Ser
  VARIANT (191)..(191): Xaa is Tyr or Val
  VARIANT (192)..(192): Xaa is Gln or Ser
  VARIANT (197)..(197): Xaa is Gln or Ser
  VARIANT (199)..(199): Xaa is Tyr or Val
  VARIANT (200)..(200): Xaa is Gln or Ser
  VARIANT (205)..(205): Xaa is Gln or Ser
  VARIANT (207)..(207): Xaa is Tyr or Val
  VARIANT (208)..(208): Xaa is Gln or Ser
  VARIANT (213)..(213): Xaa is Gln or Ser
  VARIANT (215)..(215): Xaa is Tyr or Val
  VARIANT (216)..(216): Xaa is Gln or Ser
  VARIANT (221)..(221): Xaa is Gln or Ser
  VARIANT (223)..(223): Xaa is Tyr or Val
  VARIANT (224)..(224): Xaa is Gln or Ser
  VARIANT (229)..(229): Xaa is Gln or Ser
  VARIANT (231)..(231): Xaa is Tyr or Val
  VARIANT (232)..(232): Xaa is Gln or Ser
  VARIANT (237)..(237): Xaa is Gln or Ser
  VARIANT (239)..(239): Xaa is Tyr or Val
  VARIANT (240)..(240): Xaa is Gln or Ser
  VARIANT (245)..(245): Xaa is Gln or Ser
  VARIANT (247)..(247): Xaa is Tyr or Val
  VARIANT (248)..(248): Xaa is Gln or Ser
  VARIANT (253)..(253): Xaa is Gln or Ser
  VARIANT (255)..(255): Xaa is Tyr or Val
  VARIANT (256)..(256): Xaa is Gln or Ser
  VARIANT (261)..(261): Xaa is Gln or Ser
  VARIANT (263)..(263): Xaa is Tyr or Val
  VARIANT (264)..(264): Xaa is Gln or Ser
  VARIANT (269)..(269): Xaa is Gln or Ser
  VARIANT (271)..(271): Xaa is Tyr or Val
  VARIANT (272)..(272): Xaa is Gln or Ser
  VARIANT (277)..(277): Xaa is Gln or Ser
  VARIANT (279)..(279): Xaa is Tyr or Val
  VARIANT (280)..(280): Xaa is Gln or Ser
  VARIANT (285)..(285): Xaa is Gln or Ser
  VARIANT (287)..(287): Xaa is Tyr or Val
  VARIANT (288)..(288): Xaa is Gln or Ser
  VARIANT (293)..(293): Xaa is Gln or Ser
  VARIANT (295)..(295): Xaa is Tyr or Val
  VARIANT (296)..(296): Xaa is Gln or Ser
  VARIANT (301)..(301): Xaa is Gln or Ser
  VARIANT (303)..(303): Xaa is Tyr or Val
  VARIANT (304)..(304): Xaa is Gln or Ser
  VARIANT (309)..(309): Xaa is Gln or Ser
  VARIANT (311)..(311): Xaa is Tyr or Val
  VARIANT (312)..(312): Xaa is Gln or Ser
  VARIANT (317)..(317): Xaa is Gln or Ser
  VARIANT (319)..(319): Xaa is Tyr or Val
  VARIANT (320)..(320): Xaa is Gln or Ser
  VARIANT (325)..(325): Xaa is Gln or Ser
  VARIANT (327)..(327): Xaa is Tyr or Val
  VARIANT (328)..(328): Xaa is Gln or Ser
  VARIANT (333)..(333): Xaa is Gln or Ser
  VARIANT (335)..(335): Xaa is Tyr or Val
  VARIANT (336)..(336): Xaa is Gln or Ser
  VARIANT (341)..(341): Xaa is Gln or Ser
  VARIANT (343)..(343): Xaa is Tyr or Val
  VARIANT (344)..(344): Xaa is Gln or Ser
  VARIANT (349)..(349): Xaa is Gln or Ser
  VARIANT (351)..(351): Xaa is Tyr or Val
  VARIANT (352)..(352): Xaa is Gln or Ser
  VARIANT (357)..(357): Xaa is Gln or Ser
  VARIANT (359)..(359): Xaa is Tyr or Val
  VARIANT (360)..(360): Xaa is Gln or Ser
  VARIANT (365)..(365): Xaa is Gln or Ser
  VARIANT (367)..(367): Xaa is Tyr or Val
  VARIANT (368)..(368): Xaa is Gln or Ser
  VARIANT (373)..(373): Xaa is Gln or Ser
  VARIANT (375)..(375): Xaa is Tyr or Val
  VARIANT (376)..(376): Xaa is Gln or Ser
  VARIANT (381)..(381): Xaa is Gln or Ser
  VARIANT (383)..(383): Xaa is Tyr or Val
  VARIANT (384)..(384): Xaa is Gln or Ser
  VARIANT (389)..(389): Xaa is Gln or Ser
  VARIANT (391)..(391): Xaa is Tyr or Val
  VARIANT (392)..(392): Xaa is Gln or Ser
  VARIANT (397)..(397): Xaa is Gln or Ser
  VARIANT (399)..(399): Xaa is Tyr or Val
  VARIANT (400)..(400): Xaa is Gln or Ser
  VARIANT (405)..(405): Xaa is Gln or Ser
  VARIANT (407)..(407): Xaa is Tyr or Val
  VARIANT (408)..(408): Xaa is Gln or Ser
  VARIANT (413)..(413): Xaa is Gln or Ser
  VARIANT (415)..(415): Xaa is Tyr or Val
  VARIANT (416)..(416): Xaa is Gln or Ser
  VARIANT (421)..(421): Xaa is Gln or Ser
  VARIANT (423)..(423): Xaa is Tyr or Val
  VARIANT (424)..(424): Xaa is Gln or Ser
  VARIANT (429)..(429): Xaa is Gln or Ser
  VARIANT (431)..(431): Xaa is Tyr or Val
  VARIANT (432)..(432): Xaa is Gln or Ser
  VARIANT (437)..(437): Xaa is Gln or Ser
  VARIANT (439)..(439): Xaa is Tyr or Val
  VARIANT (440)..(440): Xaa is Gln or Ser
  VARIANT (445)..(445): Xaa is Gln or Ser
  VARIANT (447)..(447): Xaa is Tyr or Val
  VARIANT (448)..(448): Xaa is Gln or Ser
  VARIANT (453)..(453): Xaa is Gln or Ser
  VARIANT (455)..(455): Xaa is Tyr or Val
  VARIANT (456)..(456): Xaa is Gln or Ser
  VARIANT (461)..(461): Xaa is Gln or Ser
  VARIANT (463)..(463): Xaa is Tyr or Val
  VARIANT (464)..(464): Xaa is Gln or Ser
  VARIANT (469)..(469): Xaa is Gln or Ser
  VARIANT (471)..(471): Xaa is Tyr or Val
  VARIANT (472)..(472): Xaa is Gln or Ser
  VARIANT (477)..(477): Xaa is Gln or Ser
  VARIANT (479)..(479): Xaa is Tyr or Val
  VARIANT (480)..(480): Xaa is Gln or Ser
  VARIANT (485)..(485): Xaa is Gln or Ser
  VARIANT (487)..(487): Xaa is Tyr or Val
  VARIANT (488)..(488): Xaa is Gln or Ser
  VARIANT (493)..(493): Xaa is Gln or Ser
  VARIANT (495)..(495): Xaa is Tyr or Val
  VARIANT (496)..(496): Xaa is Gln or Ser
  VARIANT (501)..(501): Xaa is Gln or Ser
  VARIANT (503)..(503): Xaa is Tyr or Val
  VARIANT (504)..(504): Xaa is Gln or Ser
  VARIANT (509)..(509): Xaa is Gln or Ser
  VARIANT (511)..(511): Xaa is Tyr or Val
  VARIANT (512)..(512): Xaa is Gln or Ser
  VARIANT (517)..(517): Xaa is Gln or Ser
  VARIANT (519)..(519): Xaa is Tyr or Val
  VARIANT (520)..(520): Xaa is Gln or Ser
  VARIANT (525)..(525): Xaa is Gln or Ser
  VARIANT (527)..(527): Xaa is Tyr or Val
  VARIANT (528)..(528): Xaa is Gln or Ser
  VARIANT (533)..(533): Xaa is Gln or Ser
  VARIANT (535)..(535): Xaa is Tyr or Val
  VARIANT (536)..(536): Xaa is Gln or Ser
  VARIANT (541)..(541): Xaa is Gln or Ser
  VARIANT (543)..(543): Xaa is Tyr or Val
  VARIANT (544)..(544): Xaa is Gln or Ser
  VARIANT (549)..(549): Xaa is Gln or Ser
  VARIANT (551)..(551): Xaa is Tyr or Val
  VARIANT (552)..(552): Xaa is Gln or Ser
  VARIANT (557)..(557): Xaa is Gln or Ser
  VARIANT (559)..(559): Xaa is Tyr or Val
  VARIANT (560)..(560): Xaa is Gln or Ser
  VARIANT (565)..(565): Xaa is Gln or Ser
  VARIANT (567)..(567): Xaa is Tyr or Val
  VARIANT (568)..(568): Xaa is Gln or Ser
  VARIANT (573)..(573): Xaa is Gln or Ser
  VARIANT (575)..(575): Xaa is Tyr or Val
  VARIANT (576)..(576): Xaa is Gln or Ser
  VARIANT (581)..(581): Xaa is Gln or Ser
  VARIANT (583)..(583): Xaa is Tyr or Val
  VARIANT (584)..(584): Xaa is Gln or Ser
  VARIANT (589)..(589): Xaa is Gln or Ser
  VARIANT (591)..(591): Xaa is Tyr or Val
  VARIANT (592)..(592): Xaa is Gln or Ser
  VARIANT (597)..(597): Xaa is Gln or Ser
  VARIANT (599)..(599): Xaa is Tyr or Val
  VARIANT (600)..(600): Xaa is Gln or Ser
  VARIANT (605)..(605): Xaa is Gln or Ser
  VARIANT (607)..(607): Xaa is Tyr or Val
  VARIANT (608)..(608): Xaa is Gln or Ser
  VARIANT (613)..(613): Xaa is Gln or Ser
  VARIANT (615)..(615): Xaa is Tyr or Val
  VARIANT (616)..(616): Xaa is Gln or Ser
  VARIANT (621)..(621): Xaa is Gln or Ser
  VARIANT (623)..(623): Xaa is Tyr or Val
  VARIANT (624)..(624): Xaa is Gln or Ser
  VARIANT (629)..(629): Xaa is Gln or Ser
  VARIANT (631)..(631): Xaa is Tyr or Val
  VARIANT (632)..(632): Xaa is Gln or Ser
  VARIANT (637)..(637): Xaa is Gln or Ser
  VARIANT (639)..(639): Xaa is Tyr or Val
  VARIANT (640)..(640): Xaa is Gln or Ser
  VARIANT (645)..(645): Xaa is Gln or Ser
  VARIANT (647)..(647): Xaa is Tyr or Val
  VARIANT (648)..(648): Xaa is Gln or Ser
  VARIANT (653)..(653): Xaa is Gln or Ser
  VARIANT (655)..(655): Xaa is Tyr or Val
  VARIANT (656)..(656): Xaa is Gln or Ser
  VARIANT (661)..(661): Xaa is Gln or Ser
  VARIANT (663)..(663): Xaa is Tyr or Val
  VARIANT (664)..(664): Xaa is Gln or Ser
  VARIANT (669)..(669): Xaa is Gln or Ser
  VARIANT (671)..(671): Xaa is Tyr or Val
  VARIANT (672)..(672): Xaa is Gln or Ser
  VARIANT (677)..(677): Xaa is Gln or Ser
  VARIANT (679)..(679): Xaa is Tyr or Val
  VARIANT (680)..(680): Xaa is Gln or Ser
  VARIANT (685)..(685): Xaa is Gln or Ser
  VARIANT (687)..(687): Xaa is Tyr or Val
  VARIANT (688)..(688): Xaa is Gln or Ser
  VARIANT (693)..(693): Xaa is Gln or Ser
  VARIANT (695)..(695): Xaa is Tyr or Val
  VARIANT (696)..(696): Xaa is Gln or Ser
  VARIANT (701)..(701): Xaa is Gln or Ser
  VARIANT (703)..(703): Xaa is Tyr or Val
  VARIANT (704)..(704): Xaa is Gln or Ser
  VARIANT (709)..(709): Xaa is Gln or Ser
  VARIANT (711)..(711): Xaa is Tyr or Val
  VARIANT (712)..(712): Xaa is Gln or Ser
  VARIANT (717)..(717): Xaa is Gln or Ser
  VARIANT (719)..(719): Xaa is Tyr or Val
  VARIANT (720)..(720): Xaa is Gln or Ser
  VARIANT (725)..(725): Xaa is Gln or Ser
  VARIANT (727)..(727): Xaa is Tyr or Val
  VARIANT (728)..(728): Xaa is Gln or Ser
  VARIANT (733)..(733): Xaa is Gln or Ser
  VARIANT (735)..(735): Xaa is Tyr or Val
  VARIANT (736)..(736): Xaa is Gln or Ser
  VARIANT (741)..(741): Xaa is Gln or Ser
  VARIANT (743)..(743): Xaa is Tyr or Val
  VARIANT (744)..(744): Xaa is Gln or Ser
  VARIANT (749)..(749): Xaa is Gln or Ser
  VARIANT (751)..(751): Xaa is Tyr or Val
  VARIANT (752)..(752): Xaa is Gln or Ser
  VARIANT (757)..(757): Xaa is Gln or Ser
  VARIANT (759)..(759): Xaa is Tyr or Val
  VARIANT (760)..(760): Xaa is Gln or Ser
  VARIANT (765)..(765): Xaa is Gln or Ser
  VARIANT (767)..(767): Xaa is Tyr or Val
  VARIANT (768)..(768): Xaa is Gln or Ser
  VARIANT (773)..(773): Xaa is Gln or Ser
  VARIANT (775)..(775): Xaa is Tyr or Val
  VARIANT (776)..(776): Xaa is Gln or Ser
  VARIANT (781)..(781): Xaa is Gln or Ser
  VARIANT (783)..(783): Xaa is Tyr or Val
  VARIANT (784)..(784): Xaa is Gln or Ser
  VARIANT (789)..(789): Xaa is Gln or Ser
  VARIANT (791)..(791): Xaa is Tyr or Val
  VARIANT (792)..(792): Xaa is Gln or Ser
  VARIANT (797)..(797): Xaa is Gln or Ser
  VARIANT (799)..(799): Xaa is Tyr or Val
  VARIANT (800)..(800): Xaa is Gln or Ser
  VARIANT (805)..(805): Xaa is Gln or Ser
  VARIANT (807)..(807): Xaa is Tyr or Val
  VARIANT (808)..(808): Xaa is Gln or Ser
  VARIANT (813)..(813): Xaa is Gln or Ser
  VARIANT (815)..(815): Xaa is Tyr or Val
  VARIANT (816)..(816): Xaa is Gln or Ser
  VARIANT (821)..(821): Xaa is Gln or Ser
  VARIANT (823)..(823): Xaa is Tyr or Val
  VARIANT (824)..(824): Xaa is Gln or Ser
  VARIANT (829)..(829): Xaa is Gln or Ser
  VARIANT (831)..(831): Xaa is Tyr or Val
  VARIANT (832)..(832): Xaa is Gln or Ser
  VARIANT (837)..(837): Xaa is Gln or Ser
  VARIANT (839)..(839): Xaa is Tyr or Val
  VARIANT (840)..(840): Xaa is Gln or Ser
  VARIANT (845)..(845): Xaa is Gln or Ser
  VARIANT (847)..(847): Xaa is Tyr or Val
  VARIANT (848)..(848): Xaa is Gln or Ser
  VARIANT (853)..(853): Xaa is Gln or Ser
  VARIANT (855)..(855): Xaa is Tyr or Val
  VARIANT (856)..(856): Xaa is Gln or Ser
  VARIANT (861)..(861): Xaa is Gln or Ser
  VARIANT (863)..(863): Xaa is Tyr or Val
  VARIANT (864)..(864): Xaa is Gln or Ser
  VARIANT (869)..(869): Xaa is Gln or Ser
  VARIANT (871)..(871): Xaa is Tyr or Val
  VARIANT (872)..(872): Xaa is Gln or Ser
  VARIANT (877)..(877): Xaa is Gln or Ser
  VARIANT (879)..(879): Xaa is Tyr or Val
  VARIANT (880)..(880): Xaa is Gln or Ser
  VARIANT (885)..(885): Xaa is Gln or Ser
  VARIANT (887)..(887): Xaa is Tyr or Val
  VARIANT (888)..(888): Xaa is Gln or Ser
  VARIANT (893)..(893): Xaa is Gln or Ser
  VARIANT (895)..(895): Xaa is Tyr or Val
  VARIANT (896)..(896): Xaa is Gln or Ser
  VARIANT (901)..(901): Xaa is Gln or Ser
  VARIANT (903)..(903): Xaa is Tyr or Val
  VARIANT (904)..(904): Xaa is Gln or Ser
  VARIANT (909)..(909): Xaa is Gln or Ser
  VARIANT (911)..(911): Xaa is Tyr or Val
  VARIANT (912)..(912): Xaa is Gln or Ser
  VARIANT (917)..(917): Xaa is Gln or Ser
  VARIANT (919)..(919): Xaa is Tyr or Val
  VARIANT (920)..(920): Xaa is Gln or Ser
  VARIANT (925)..(925): Xaa is Gln or Ser
  VARIANT (927)..(927): Xaa is Tyr or Val
  VARIANT (928)..(928): Xaa is Gln or Ser
  VARIANT (933)..(933): Xaa is Gln or Ser
  VARIANT (935)..(935): Xaa is Tyr or Val
  VARIANT (936)..(936): Xaa is Gln or Ser
  VARIANT (941)..(941): Xaa is Gln or Ser
  VARIANT (943)..(943): Xaa is Tyr or Val
  VARIANT (944)..(944): Xaa is Gln or Ser
  VARIANT (949)..(949): Xaa is Gln or Ser
  VARIANT (951)..(951): Xaa is Tyr or Val
  VARIANT (952)..(952): Xaa is Gln or Ser
  VARIANT (957)..(957): Xaa is Gln or Ser
  VARIANT (959)..(959): Xaa is Tyr or Val
  VARIANT (960)..(960): Xaa is Gln or Ser
  VARIANT (965)..(965): Xaa is Gln or Ser
  VARIANT (967)..(967): Xaa is Tyr or Val
  VARIANT (968)..(968): Xaa is Gln or Ser
  VARIANT (973)..(973): Xaa is Gln or Ser
  VARIANT (975)..(975): Xaa is Tyr or Val
  VARIANT (976)..(976): Xaa is Gln or Ser
  VARIANT (981)..(981): Xaa is Gln or Ser
  VARIANT (983)..(983): Xaa is Tyr or Val
  VARIANT (984)..(984): Xaa is Gln or Ser
  VARIANT (989)..(989): Xaa is Gln or Ser
  VARIANT (991)..(991): Xaa is Tyr or Val
  VARIANT (992)..(992): Xaa is Gln or Ser
  VARIANT (997)..(997): Xaa is Gln or Ser
  VARIANT (999)..(999): Xaa is Tyr or Val
  VARIANT (1000)..(1000): Xaa is Gln or Ser
  VARIANT (1005)..(1005): Xaa is Gln or Ser
  VARIANT (1007)..(1007): Xaa is Tyr or Val
  VARIANT (1008)..(1008): Xaa is Gln or Ser
  VARIANT (1013)..(1013): Xaa is Gln or Ser
  VARIANT (1015)..(1015): Xaa is Tyr or Val
  VARIANT (1016)..(1016): Xaa is Gln or Ser
  VARIANT (1021)..(1021): Xaa is Gln or Ser
  VARIANT (1023)..(1023): Xaa is Tyr or Val
  VARIANT (1024)..(1024): Xaa is Gln or Ser
  VARIANT (1029)..(1029): Xaa is Gln or Ser
  VARIANT (1031)..(1031): Xaa is Tyr or Val
  VARIANT (1032)..(1032): Xaa is Gln or Ser
  VARIANT (1037)..(1037): Xaa is Gln or Ser
  VARIANT (1039)..(1039): Xaa is Tyr or Val
  VARIANT (1040)..(1040): Xaa is Gln or Ser
  VARIANT (1045)..(1045): Xaa is Gln or Ser
  VARIANT (1047)..(1047): Xaa is Tyr or Val
  VARIANT (1048)..(1048): Xaa is Gln or Ser
  VARIANT (1053)..(1053): Xaa is Gln or Ser
  VARIANT (1055)..(1055): Xaa is Tyr or Val
  VARIANT (1056)..(1056): Xaa is Gln or Ser
  VARIANT (1061)..(1061): Xaa is Gln or Ser
  VARIANT (1063)..(1063): Xaa is Tyr or Val
  VARIANT (1064)..(1064): Xaa is Gln or Ser
  VARIANT (1069)..(1069): Xaa is Gln or Ser
  VARIANT (1071)..(1071): Xaa is Tyr or Val
  VARIANT (1072)..(1072): Xaa is Gln or Ser
  VARIANT (1077)..(1077): Xaa is Gln or Ser
  VARIANT (1079)..(1079): Xaa is Tyr or Val
  VARIANT (1080)..(1080): Xaa is Gln or Ser
  VARIANT (1085)..(1085): Xaa is Gln or Ser
  VARIANT (1087)..(1087): Xaa is Tyr or Val
  VARIANT (1088)..(1088): Xaa is Gln or Ser
  VARIANT (1093)..(1093): Xaa is Gln or Ser
  VARIANT (1095)..(1095): Xaa is Tyr or Val
  VARIANT (1096)..(1096): Xaa is Gln or Ser
  VARIANT (1101)..(1101): Xaa is Gln or Ser
  VARIANT (1103)..(1103): Xaa is Tyr or Val
  VARIANT (1104)..(1104): Xaa is Gln or Ser
  VARIANT (1109)..(1109): Xaa is Gln or Ser
  VARIANT (1111)..(1111): Xaa is Tyr or Val
  VARIANT (1112)..(1112): Xaa is Gln or Ser
  VARIANT (1117)..(1117): Xaa is Gln or Ser
  VARIANT (1119)..(1119): Xaa is Tyr or Val
  VARIANT (1120)..(1120): Xaa is Gln or Ser
  VARIANT (1125)..(1125): Xaa is Gln or Ser
  VARIANT (1127)..(1127): Xaa is Tyr or Val
  VARIANT (1128)..(1128): Xaa is Gln or Ser
  VARIANT (1133)..(1133): Xaa is Gln or Ser
  VARIANT (1135)..(1135): Xaa is Tyr or Val
  VARIANT (1136)..(1136): Xaa is Gln or Ser
  VARIANT (1141)..(1141): Xaa is Gln or Ser
  VARIANT (1143)..(1143): Xaa is Tyr or Val
  VARIANT (1144)..(1144): Xaa is Gln or Ser
  VARIANT (1149)..(1149): Xaa is Gln or Ser
  VARIANT (1151)..(1151): Xaa is Tyr or Val
  VARIANT (1152)..(1152): Xaa is Gln or Ser
  VARIANT (1157)..(1157): Xaa is Gln or Ser
  VARIANT (1159)..(1159): Xaa is Tyr or Val
  VARIANT (1160)..(1160): Xaa is Gln or Ser
  VARIANT (1165)..(1165): Xaa is Gln or Ser
  VARIANT (1167)..(1167): Xaa is Tyr or Val
  VARIANT (1168)..(1168): Xaa is Gln or Ser
  VARIANT (1173)..(1173): Xaa is Gln or Ser
  VARIANT (1175)..(1175): Xaa is Tyr or Val
  VARIANT (1176)..(1176): Xaa is Gln or Ser
  VARIANT (1181)..(1181): Xaa is Gln or Ser
  VARIANT (1183)..(1183): Xaa is Tyr or Val
  VARIANT (1184)..(1184): Xaa is Gln or Ser
  VARIANT (1189)..(1189): Xaa is Gln or Ser
  VARIANT (1191)..(1191): Xaa is Tyr or Val
  VARIANT (1192)..(1192): Xaa is Gln or Ser
  VARIANT (1197)..(1197): Xaa is Gln or Ser
  VARIANT (1199)..(1199): Xaa is Tyr or Val
  VARIANT (1200)..(1200): Xaa is Gln or Ser
  VARIANT (1205)..(1205): Xaa is Gln or Ser
  VARIANT (1207)..(1207): Xaa is Tyr or Val
  VARIANT (1208)..(1208): Xaa is Gln or Ser
  VARIANT (1213)..(1213): Xaa is Gln or Ser
  VARIANT (1215)..(1215): Xaa is Tyr or Val
  VARIANT (1216)..(1216): Xaa is Gln or Ser
  VARIANT (1221)..(1221): Xaa is Gln or Ser
  VARIANT (1223)..(1223): Xaa is Tyr or Val
  VARIANT (1224)..(1224): Xaa is Gln or Ser
  VARIANT (1229)..(1229): Xaa is Gln or Ser
  VARIANT (1231)..(1231): Xaa is Tyr or Val
  VARIANT (1232)..(1232): Xaa is Gln or Ser
  VARIANT (1237)..(1237): Xaa is Gln or Ser
  VARIANT (1239)..(1239): Xaa is Tyr or Val
  VARIANT (1240)..(1240): Xaa is Gln or Ser
  VARIANT (1245)..(1245): Xaa is Gln or Ser
  VARIANT (1247)..(1247): Xaa is Tyr or Val
  VARIANT (1248)..(1248): Xaa is Gln or Ser
  VARIANT (1253)..(1253): Xaa is Gln or Ser
  VARIANT (1255)..(1255): Xaa is Tyr or Val
  VARIANT (1256)..(1256): Xaa is Gln or Ser
  VARIANT (1261)..(1261): Xaa is Gln or Ser
  VARIANT (1263)..(1263): Xaa is Tyr or Val
  VARIANT (1264)..(1264): Xaa is Gln or Ser
  VARIANT (1269)..(1269): Xaa is Gln or Ser
  VARIANT (1271)..(1271): Xaa is Tyr or Val
  VARIANT (1272)..(1272): Xaa is Gln or Ser
  VARIANT (1277)..(1277): Xaa is Gln or Ser
  VARIANT (1279)..(1279): Xaa is Tyr or Val
  VARIANT (1280)..(1280): Xaa is Gln or Ser
GRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXX

SEQ ID NO: 153 - protein, 1280 aa, Artificial Sequence
  elastin-like polypeptide
  VARIANT (1)..(1): Xaa is Gln or Ser
  VARIANT (2)..(2): Xaa is Tyr or Val
  VARIANT (4)..(4): Xaa is Gln or Ser
  VARIANT (9)..(9): Xaa is Gln or Ser
  VARIANT (10)..(10): Xaa is Tyr or Val
  VARIANT (12)..(12): Xaa is Gln or Ser
  VARIANT (17)..(17): Xaa is Gln or Ser
  VARIANT (18)..(18): Xaa is Tyr or Val
  VARIANT (20)..(20): Xaa is Gln or Ser
  VARIANT (25)..(25): Xaa is Gln or Ser
  VARIANT (26)..(26): Xaa is Tyr or Val
  VARIANT (28)..(28): Xaa is Gln or Ser
  VARIANT (33)..(33): Xaa is Gln or Ser
  VARIANT (34)..(34): Xaa is Tyr or Val
  VARIANT (36)..(36): Xaa is Gln or Ser
  VARIANT (41)..(41): Xaa is Gln or Ser
  VARIANT (42)..(42): Xaa is Tyr or Val
  VARIANT (44)..(44): Xaa is Gln or Ser
  VARIANT (49)..(49): Xaa is Gln or Ser
  VARIANT (50)..(50): Xaa is Tyr or Val
  VARIANT (52)..(52): Xaa is Gln or Ser
  VARIANT (57)..(57): Xaa is Gln or Ser
  VARIANT (58)..(58): Xaa is Tyr or Val
  VARIANT (60)..(60): Xaa is Gln or Ser
  VARIANT (65)..(65): Xaa is Gln or Ser
  VARIANT (66)..(66): Xaa is Tyr or Val
  VARIANT (68)..(68): Xaa is Gln or Ser
  VARIANT (73)..(73): Xaa is Gln or Ser
  VARIANT (74)..(74): Xaa is Tyr or Val
  VARIANT (76)..(76): Xaa is Gln or Ser
  VARIANT (81)..(1280): May be present or absent in groups of the repeat unit Xaa Xaa Pro Xaa Asp Gly Arg Gly
  VARIANT (81)..(81): Xaa is Gln or Ser
  VARIANT (82)..(82): Xaa is Tyr or Val
  VARIANT (84)..(84): Xaa is Gln or Ser
  VARIANT (89)..(89): Xaa is Gln or Ser
  VARIANT (90)..(90): Xaa is Tyr or Val
  VARIANT (92)..(92): Xaa is Gln or Ser
  VARIANT (97)..(97): Xaa is Gln or Ser
  VARIANT (98)..(98): Xaa is Tyr or Val
  VARIANT (100)..(100): Xaa is Gln or Ser
  VARIANT (105)..(105): Xaa is Gln or Ser
  VARIANT (106)..(106): Xaa is Tyr or Val
  VARIANT (108)..(108): Xaa is Gln or Ser
  VARIANT (113)..(113): Xaa is Gln or Ser
  VARIANT (114)..(114): Xaa is Tyr or Val
  VARIANT (116)..(116): Xaa is Gln or Ser
  VARIANT (121)..(121): Xaa is Gln or Ser
  VARIANT (122)..(122): Xaa is Tyr or Val
  VARIANT (124)..(124): Xaa is Gln or Ser
  VARIANT (129)..(129): Xaa is Gln or Ser
  VARIANT (130)..(130): Xaa is Tyr or Val
  VARIANT (132)..(132): Xaa is Gln or Ser
  VARIANT (137)..(137): Xaa is Gln or Ser
  VARIANT (138)..(138): Xaa is Tyr or Val
  VARIANT (140)..(140): Xaa is Gln or Ser
  VARIANT (145)..(145): Xaa is Gln or Ser
  VARIANT (146)..(146): Xaa is Tyr or Val
  VARIANT (148)..(148): Xaa is Gln or Ser
  VARIANT (153)..(153): Xaa is Gln or Ser
  VARIANT (154)..(154): Xaa is Tyr or Val
  VARIANT (156)..(156): Xaa is Gln or Ser
  VARIANT (161)..(161): Xaa is Gln or Ser
  VARIANT (162)..(162): Xaa is Tyr or Val
  VARIANT (164)..(164): Xaa is Gln or Ser
  VARIANT (169)..(169): Xaa is Gln or Ser
  VARIANT (170)..(170): Xaa is Tyr or Val
  VARIANT (172)..(172): Xaa is Gln or Ser
  VARIANT (177)..(177): Xaa is Gln or Ser
  VARIANT (178)..(178): Xaa is Tyr or Val
  VARIANT (180)..(180): Xaa is Gln or Ser
  VARIANT (185)..(185): Xaa is Gln or Ser
  VARIANT (186)..(186): Xaa is Tyr or Val
  VARIANT (188)..(188): Xaa is Gln or Ser
  VARIANT (193)..(193): Xaa is Gln or Ser
  VARIANT (194)..(194): Xaa is Tyr or Val
  VARIANT (196)..(196): Xaa is Gln or Ser
  VARIANT (201)..(201): Xaa is Gln or Ser
  VARIANT (202)..(202): Xaa is Tyr or Val
  VARIANT (204)..(204): Xaa is Gln or Ser
  VARIANT (209)..(209): Xaa is Gln or Ser
  VARIANT (210)..(210): Xaa is Tyr or Val
  VARIANT (212)..(212): Xaa is Gln or Ser
  VARIANT (217)..(217): Xaa is Gln or Ser
  VARIANT (218)..(218): Xaa is Tyr or Val
  VARIANT (220)..(220): Xaa is Gln or Ser
  VARIANT (225)..(225): Xaa is Gln or Ser
  VARIANT (226)..(226): Xaa is Tyr or Val
  VARIANT (228)..(228): Xaa is Gln or Ser
  VARIANT (233)..(233): Xaa is Gln or Ser
  VARIANT (234)..(234): Xaa is Tyr or Val
  VARIANT (236)..(236): Xaa is Gln or Ser
  VARIANT (241)..(241): Xaa is Gln or Ser
  VARIANT (242)..(242): Xaa is Tyr or Val
  VARIANT (244)..(244): Xaa is Gln or Ser
  VARIANT (249)..(249): Xaa is Gln or Ser
  VARIANT (250)..(250): Xaa is Tyr or Val
  VARIANT (252)..(252): Xaa is Gln or Ser
  VARIANT (257)..(257): Xaa is Gln or Ser
  VARIANT (258)..(258): Xaa is Tyr or Val
  VARIANT (260)..(260): Xaa is Gln or Ser
  VARIANT (265)..(265): Xaa is Gln or Ser
  VARIANT (266)..(266): Xaa is Tyr or Val
  VARIANT (268)..(268): Xaa is Gln or Ser
  VARIANT (273)..(273): Xaa is Gln or Ser
  VARIANT (274)..(274): Xaa is Tyr or Val
  VARIANT (276)..(276): Xaa is Gln or Ser
  VARIANT (281)..(281): Xaa is Gln or Ser
  VARIANT (282)..(282): Xaa is Tyr or Val
  VARIANT (284)..(284): Xaa is Gln or Ser
  VARIANT (289)..(289): Xaa is Gln or Ser
  VARIANT (290)..(290): Xaa is Tyr or Val
  VARIANT (292)..(292): Xaa is Gln or Ser
  VARIANT (297)..(297): Xaa is Gln or Ser
  VARIANT (298)..(298): Xaa is Tyr or Val
  VARIANT (300)..(300): Xaa is Gln or Ser
  VARIANT (305)..(305): Xaa is Gln or Ser
  VARIANT (306)..(306): Xaa is Tyr or Val
  VARIANT (308)..(308): Xaa is Gln or Ser
  VARIANT (313)..(313): Xaa is Gln or Ser
  VARIANT (314)..(314): Xaa is Tyr or Val
  VARIANT (316)..(316): Xaa is Gln or Ser
  VARIANT (321)..(321): Xaa is Gln or Ser
  VARIANT (322)..(322): Xaa is Tyr or Val
  VARIANT (324)..(324): Xaa is Gln or Ser
  VARIANT (329)..(329): Xaa is Gln or Ser
  VARIANT (330)..(330): Xaa is Tyr or Val
  VARIANT (332)..(332): Xaa is Gln or Ser
  VARIANT (337)..(337): Xaa is Gln or Ser
  VARIANT (338)..(338): Xaa is Tyr or Val
  VARIANT (340)..(340): Xaa is Gln or Ser
  VARIANT (345)..(345): Xaa is Gln or Ser
  VARIANT (346)..(346): Xaa is Tyr or Val
  VARIANT (348)..(348): Xaa is Gln or Ser
  VARIANT (353)..(353): Xaa is Gln or Ser
  VARIANT (354)..(354): Xaa is Tyr or Val
  VARIANT (356)..(356): Xaa is Gln or Ser
  VARIANT (361)..(361): Xaa is Gln or Ser
  VARIANT (362)..(362): Xaa is Tyr or Val
  VARIANT (364)..(364): Xaa is Gln or Ser
  VARIANT (369)..(369): Xaa is Gln or Ser
  VARIANT (370)..(370): Xaa is Tyr or Val
  VARIANT (372)..(372): Xaa is Gln or Ser
  VARIANT (377)..(377): Xaa is Gln or Ser
  VARIANT (378)..(378): Xaa is Tyr or Val
  VARIANT (380)..(380): Xaa is Gln or Ser
  VARIANT (385)..(385): Xaa is Gln or Ser
  VARIANT (386)..(386): Xaa is Tyr or Val
  VARIANT (388)..(388): Xaa is Gln or Ser
  VARIANT (393)..(393): Xaa is Gln or Ser
  VARIANT (394)..(394): Xaa is Tyr or Val
  VARIANT (396)..(396): Xaa is Gln or Ser
  VARIANT (401)..(401): Xaa is Gln or Ser
  VARIANT (402)..(402): Xaa is Tyr or Val
  VARIANT (404)..(404): Xaa is Gln or Ser
  VARIANT (409)..(409): Xaa is Gln or Ser
  VARIANT (410)..(410): Xaa is Tyr or Val
  VARIANT (412)..(412): Xaa is Gln or Ser
  VARIANT (417)..(417): Xaa is Gln or Ser
  VARIANT (418)..(418): Xaa is Tyr or Val
  VARIANT (420)..(420): Xaa is Gln or Ser
  VARIANT (425)..(425): Xaa is Gln or Ser
  VARIANT (426)..(426): Xaa is Tyr or Val
  VARIANT (428)..(428): Xaa is Gln or Ser
  VARIANT (433)..(433): Xaa is Gln or Ser
  VARIANT (434)..(434): Xaa is Tyr or Val
  VARIANT (436)..(436): Xaa is Gln or Ser
  VARIANT (441)..(441): Xaa is Gln or Ser
  VARIANT (442)..(442): Xaa is Tyr or Val
  VARIANT (444)..(444): Xaa is Gln or Ser
  VARIANT (449)..(449): Xaa is Gln or Ser
  VARIANT (450)..(450): Xaa is Tyr or Val
  VARIANT (452)..(452): Xaa is Gln or Ser
  VARIANT (457)..(457): Xaa is Gln or Ser
  VARIANT (458)..(458): Xaa is Tyr or Val
  VARIANT (460)..(460): Xaa is Gln or Ser
  VARIANT (465)..(465): Xaa is Gln or Ser
  VARIANT (466)..(466): Xaa is Tyr or Val
  VARIANT (468)..(468): Xaa is Gln or Ser
  VARIANT (473)..(473): Xaa is Gln or Ser
  VARIANT (474)..(474): Xaa is Tyr or Val
  VARIANT (476)..(476): Xaa is Gln or Ser
  VARIANT (481)..(481): Xaa is Gln or Ser
  VARIANT (482)..(482): Xaa is Tyr or Val
  VARIANT (484)..(484): Xaa is Gln or Ser
  VARIANT (489)..(489): Xaa is Gln or Ser
  VARIANT (490)..(490): Xaa is Tyr or Val
  VARIANT (492)..(492): Xaa is Gln or Ser
  VARIANT (497)..(497): Xaa is Gln or Ser
  VARIANT (498)..(498): Xaa is Tyr or Val
  VARIANT (500)..(500): Xaa is Gln or Ser
  VARIANT (505)..(505): Xaa is Gln or Ser
  VARIANT (506)..(506): Xaa is Tyr or Val
  VARIANT (508)..(508): Xaa is Gln or Ser
  VARIANT (513)..(513): Xaa is Gln or Ser
  VARIANT (514)..(514): Xaa is Tyr or Val
  VARIANT (516)..(516): Xaa is Gln or Ser
  VARIANT (521)..(521): Xaa is Gln or Ser
  VARIANT (522)..(522): Xaa is Tyr or Val
  VARIANT (524)..(524): Xaa is Gln or Ser
  VARIANT (529)..(529): Xaa is Gln or Ser
  VARIANT (530)..(530): Xaa is Tyr or Val
  VARIANT (532)..(532): Xaa is Gln or Ser
  VARIANT (537)..(537): Xaa is Gln or Ser
  VARIANT (538)..(538): Xaa is Tyr or Val
  VARIANT (540)..(540): Xaa is Gln or Ser
  VARIANT (545)..(545): Xaa is Gln or Ser
  VARIANT (546)..(546): Xaa is Tyr or Val
  VARIANT (548)..(548): Xaa is Gln or Ser
  VARIANT (553)..(553): Xaa is Gln or Ser
  VARIANT (554)..(554): Xaa is Tyr or Val
  VARIANT (556)..(556): Xaa is Gln or Ser
  VARIANT (561)..(561): Xaa is Gln or Ser
  VARIANT (562)..(562): Xaa is Tyr or Val
  VARIANT (564)..(564): Xaa is Gln or Ser
  VARIANT (569)..(569): Xaa is Gln or Ser
  VARIANT (570)..(570): Xaa is Tyr or Val
  VARIANT (572)..(572): Xaa is Gln or Ser
  VARIANT (577)..(577): Xaa is Gln or Ser
  VARIANT (578)..(578): Xaa is Tyr or Val
  VARIANT (580)..(580): Xaa is Gln or Ser
  VARIANT (585)..(585): Xaa is Gln or Ser
  VARIANT (586)..(586): Xaa is Tyr or Val
  VARIANT (588)..(588): Xaa is Gln or Ser
  VARIANT (593)..(593): Xaa is Gln or Ser
  VARIANT (594)..(594): Xaa is Tyr or Val
  VARIANT (596)..(596): Xaa is Gln or Ser
  VARIANT (601)..(601): Xaa is Gln or Ser
  VARIANT (602)..(602): Xaa is Tyr or Val
  VARIANT (604)..(604): Xaa is Gln or Ser
  VARIANT (609)..(609): Xaa is Gln or Ser
  VARIANT (610)..(610): Xaa is Tyr or Val
  VARIANT (612)..(612): Xaa is Gln or Ser
  VARIANT (617)..(617): Xaa is Gln or Ser
  VARIANT (618)..(618): Xaa is Tyr or Val
  VARIANT (620)..(620): Xaa is Gln or Ser
  VARIANT (625)..(625): Xaa is Gln or Ser
  VARIANT (626)..(626): Xaa is Tyr or Val
  VARIANT (628)..(628): Xaa is Gln or Ser
  VARIANT (633)..(633): Xaa is Gln or Ser
  VARIANT (634)..(634): Xaa is Tyr or Val
  VARIANT (636)..(636): Xaa is Gln or Ser
  VARIANT (641)..(641): Xaa is Gln or Ser
  VARIANT (642)..(642): Xaa is Tyr or Val
  VARIANT (644)..(644): Xaa is Gln or Ser
  VARIANT (649)..(649): Xaa is Gln or Ser
  VARIANT (650)..(650): Xaa is Tyr or Val
  VARIANT (652)..(652): Xaa is Gln or Ser
  VARIANT (657)..(657): Xaa is Gln or Ser
  VARIANT (658)..(658): Xaa is Tyr or Val
  VARIANT (660)..(660): Xaa is Gln or Ser
  VARIANT (665)..(665): Xaa is Gln or Ser
  VARIANT (666)..(666): Xaa is Tyr or Val
  VARIANT (668)..(668): Xaa is Gln or Ser
  VARIANT (673)..(673): Xaa is Gln or Ser
  VARIANT (674)..(674): Xaa is Tyr or Val
  VARIANT (676)..(676): Xaa is Gln or Ser
  VARIANT (681)..(681): Xaa is Gln or Ser
  VARIANT (682)..(682): Xaa is Tyr or Val
  VARIANT (684)..(684): Xaa is Gln or Ser
  VARIANT (689)..(689): Xaa is Gln or Ser
  VARIANT (690)..(690): Xaa is Tyr or Val
  VARIANT (692)..(692): Xaa is Gln or Ser
  VARIANT (697)..(697): Xaa is Gln or Ser
  VARIANT (698)..(698): Xaa is Tyr or Val
  VARIANT (700)..(700): Xaa is Gln or Ser
  VARIANT (705)..(705): Xaa is Gln or Ser
  VARIANT (706)..(706): Xaa is Tyr or Val
  VARIANT (708)..(708): Xaa is Gln or Ser
  VARIANT (713)..(713): Xaa is Gln or Ser
  VARIANT (714)..(714): Xaa is Tyr or Val
  VARIANT (716)..(716): Xaa is Gln or Ser
  VARIANT (721)..(721): Xaa is Gln or Ser
  VARIANT (722)..(722): Xaa is Tyr or Val
  VARIANT (724)..(724): Xaa is Gln or Ser
  VARIANT (729)..(729): Xaa is Gln or Ser
  VARIANT (730)..(730): Xaa is Tyr or Val
  VARIANT (732)..(732): Xaa is Gln or Ser
  VARIANT (737)..(737): Xaa is Gln or Ser
  VARIANT (738)..(738): Xaa is Tyr or Val
  VARIANT (740)..(740): Xaa is Gln or Ser
  VARIANT (745)..(745): Xaa is Gln or Ser
  VARIANT (746)..(746): Xaa is Tyr or Val
  VARIANT (748)..(748): Xaa is Gln or Ser
  VARIANT (753)..(753): Xaa is Gln or Ser
  VARIANT (754)..(754): Xaa is Tyr or Val
  VARIANT (756)..(756): Xaa is Gln or Ser
  VARIANT (761)..(761): Xaa is Gln or Ser
  VARIANT (762)..(762): Xaa is Tyr or Val
  VARIANT (764)..(764): Xaa is Gln or Ser
  VARIANT (769)..(769): Xaa is Gln or Ser
  VARIANT (770)..(770): Xaa is Tyr or Val
  VARIANT (772)..(772): Xaa is Gln or Ser
  VARIANT (777)..(777): Xaa is Gln or Ser
  VARIANT (778)..(778): Xaa is Tyr or Val
  VARIANT (780)..(780): Xaa is Gln or Ser
  VARIANT (785)..(785): Xaa is Gln or Ser
  VARIANT (786)..(786): Xaa is Tyr or Val
  VARIANT (788)..(788): Xaa is Gln or Ser
  VARIANT (793)..(793): Xaa is Gln or Ser
  VARIANT (794)..(794): Xaa is Tyr or Val
  VARIANT (796)..(796): Xaa is Gln or Ser
  VARIANT (801)..(801): Xaa is Gln or Ser
  VARIANT (802)..(802): Xaa is Tyr or Val
  VARIANT (804)..(804): Xaa is Gln or Ser
  VARIANT (809)..(809): Xaa is Gln or Ser
  VARIANT (810)..(810): Xaa is Tyr or Val
  VARIANT (812)..(812): Xaa is Gln or Ser
  VARIANT (817)..(817): Xaa is Gln or Ser
  VARIANT (818)..(818): Xaa is Tyr or Val
  VARIANT (820)..(820): Xaa is Gln or Ser
  VARIANT (825)..(825): Xaa is Gln or Ser
  VARIANT (826)..(826): Xaa is Tyr or Val
  VARIANT (828)..(828): Xaa is Gln or Ser
  VARIANT (833)..(833): Xaa is Gln or Ser
  VARIANT (834)..(834): Xaa is Tyr or Val
  VARIANT (836)..(836): Xaa is Gln or Ser
  VARIANT (841)..(841): Xaa is Gln or Ser
  VARIANT (842)..(842): Xaa is Tyr or Val
  VARIANT (844)..(844): Xaa is Gln or Ser
  VARIANT (849)..(849): Xaa is Gln or Ser
  VARIANT (850)..(850): Xaa is Tyr or Val
  VARIANT (852)..(852): Xaa is Gln or Ser
  VARIANT (857)..(857): Xaa is Gln or Ser
  VARIANT (858)..(858): Xaa is Tyr or Val
  VARIANT (860)..(860): Xaa is Gln or Ser
  VARIANT (865)..(865): Xaa is Gln or Ser
  VARIANT (866)..(866): Xaa is Tyr or Val
  VARIANT (868)..(868): Xaa is Gln or Ser
  VARIANT (873)..(873): Xaa is Gln or Ser
  VARIANT (874)..(874): Xaa is Tyr or Val
  VARIANT (876)..(876): Xaa is Gln or Ser
  VARIANT (881)..(881): Xaa is Gln or Ser
  VARIANT (882)..(882): Xaa is Tyr or Val
  VARIANT (884)..(884): Xaa is Gln or Ser
  VARIANT (889)..(889): Xaa is Gln or Ser
  VARIANT (890)..(890): Xaa is Tyr or Val
  VARIANT (892)..(892): Xaa is Gln or Ser
  VARIANT (897)..(897): Xaa is Gln or Ser
  VARIANT (898)..(898): Xaa is Tyr or Val
  VARIANT (900)..(900): Xaa is Gln or Ser
  VARIANT (905)..(905): Xaa is Gln or Ser
  VARIANT (906)..(906): Xaa is Tyr or Val
  VARIANT (908)..(908): Xaa is Gln or Ser
  VARIANT (913)..(913): Xaa is Gln or Ser
  VARIANT (914)..(914): Xaa is Tyr or Val
  VARIANT (916)..(916): Xaa is Gln or Ser
  VARIANT (921)..(921): Xaa is Gln or Ser
  VARIANT (922)..(922): Xaa is Tyr or Val
  VARIANT (924)..(924): Xaa is Gln or Ser
  VARIANT (929)..(929): Xaa is Gln or Ser
  VARIANT (930)..(930): Xaa is Tyr or Val
  VARIANT (932)..(932): Xaa is Gln or Ser
  VARIANT (937)..(937): Xaa is Gln or Ser
  VARIANT (938)..(938): Xaa is Tyr or Val
  VARIANT (940)..(940): Xaa is Gln or Ser
  VARIANT (945)..(945): Xaa is Gln or Ser
  VARIANT (946)..(946): Xaa is Tyr or Val
  VARIANT (948)..(948): Xaa is Gln or Ser
  VARIANT (953)..(953): Xaa is Gln or Ser
  VARIANT (954)..(954): Xaa is Tyr or Val
  VARIANT (956)..(956): Xaa is Gln or Ser
  VARIANT (961)..(961): Xaa is Gln or Ser
  VARIANT (962)..(962): Xaa is Tyr or Val
  VARIANT (964)..(964): Xaa is Gln or Ser
  VARIANT (969)..(969): Xaa is Gln or Ser
  VARIANT (970)..(970): Xaa is Tyr or Val
  VARIANT (972)..(972): Xaa is Gln or Ser
  VARIANT (977)..(977): Xaa is Gln or Ser
  VARIANT (978)..(978): Xaa is Tyr or Val
  VARIANT (980)..(980): Xaa is Gln or Ser
  VARIANT (985)..(985): Xaa is Gln or Ser
  VARIANT (986)..(986): Xaa is Tyr or Val
  VARIANT (988)..(988): Xaa is Gln or Ser
  VARIANT (993)..(993): Xaa is Gln or Ser
  VARIANT (994)..(994): Xaa is Tyr or Val
  VARIANT (996)..(996): Xaa is Gln or Ser
  VARIANT (1001)..(1001): Xaa is Gln or Ser
  VARIANT (1002)..(1002): Xaa is Tyr or Val
  VARIANT (1004)..(1004): Xaa is Gln or Ser
  VARIANT (1009)..(1009): Xaa is Gln or Ser
  VARIANT (1010)..(1010): Xaa is Tyr or Val
  VARIANT (1012)..(1012): Xaa is Gln or Ser
  VARIANT (1017)..(1017): Xaa is Gln or Ser
  VARIANT (1018)..(1018): Xaa is Tyr or Val
  VARIANT (1020)..(1020): Xaa is Gln or Ser
  VARIANT (1025)..(1025): Xaa is Gln or Ser
  VARIANT (1026)..(1026): Xaa is Tyr or Val
  VARIANT (1028)..(1028): Xaa is Gln or Ser
  VARIANT (1033)..(1033): Xaa is Gln or Ser
  VARIANT (1034)..(1034): Xaa is Tyr or Val
  VARIANT (1036)..(1036): Xaa is Gln or Ser
  VARIANT (1041)..(1041): Xaa is Gln or Ser
  VARIANT (1042)..(1042): Xaa is Tyr or Val
  VARIANT (1044)..(1044): Xaa is Gln or Ser
  VARIANT (1049)..(1049): Xaa is Gln or Ser
  VARIANT (1050)..(1050): Xaa is Tyr or Val
  VARIANT (1052)..(1052): Xaa is Gln or Ser
  VARIANT (1057)..(1057): Xaa is Gln or Ser
  VARIANT (1058)..(1058): Xaa is Tyr or Val
  VARIANT (1060)..(1060): Xaa is Gln or Ser
  VARIANT (1065)..(1065): Xaa is Gln or Ser
  VARIANT (1066)..(1066): Xaa is Tyr or Val
  VARIANT (1068)..(1068): Xaa is Gln or Ser
  VARIANT (1073)..(1073): Xaa is Gln or Ser
  VARIANT (1074)..(1074): Xaa is Tyr or Val
  VARIANT (1076)..(1076): Xaa is Gln or Ser
  VARIANT (1081)..(1081): Xaa is Gln or Ser
  VARIANT (1082)..(1082): Xaa is Tyr or Val
  VARIANT (1084)..(1084): Xaa is Gln or Ser
  VARIANT (1089)..(1089): Xaa is Gln or Ser
  VARIANT (1090)..(1090): Xaa is Tyr or Val
  VARIANT (1092)..(1092): Xaa is Gln or Ser
  VARIANT (1097)..(1097): Xaa is Gln or Ser
  VARIANT (1098)..(1098): Xaa is Tyr or Val
  VARIANT (1100)..(1100): Xaa is Gln or Ser
  VARIANT (1105)..(1105): Xaa is Gln or Ser
  VARIANT (1106)..(1106): Xaa is Tyr or Val
  VARIANT (1108)..(1108): Xaa is Gln or Ser
  VARIANT (1113)..(1113): Xaa is Gln or Ser
  VARIANT (1114)..(1114): Xaa is Tyr or Val
  VARIANT (1116)..(1116): Xaa is Gln or Ser
  VARIANT (1121)..(1121): Xaa is Gln or Ser
  VARIANT (1122)..(1122): Xaa is Tyr or Val
  VARIANT (1124)..(1124): Xaa is Gln or Ser
  VARIANT (1129)..(1129): Xaa is Gln or Ser
  VARIANT (1130)..(1130): Xaa is Tyr or Val
  VARIANT (1132)..(1132): Xaa is Gln or Ser
  VARIANT (1137)..(1137): Xaa is Gln or Ser
  VARIANT (1138)..(1138): Xaa is Tyr or Val
  VARIANT (1140)..(1140): Xaa is Gln or Ser
  VARIANT (1145)..(1145): Xaa is Gln or Ser
  VARIANT (1146)..(1146): Xaa is Tyr or Val
  VARIANT (1148)..(1148): Xaa is Gln or Ser
  VARIANT (1153)..(1153): Xaa is Gln or Ser
  VARIANT (1154)..(1154): Xaa is Tyr or Val
  VARIANT (1156)..(1156): Xaa is Gln or Ser
  VARIANT (1161)..(1161): Xaa is Gln or Ser
  VARIANT (1162)..(1162): Xaa is Tyr or Val
  VARIANT (1164)..(1164): Xaa is Gln or Ser
  VARIANT (1169)..(1169): Xaa is Gln or Ser
  VARIANT (1170)..(1170): Xaa is Tyr or Val
  VARIANT (1172)..(1172): Xaa is Gln or Ser
  VARIANT (1177)..(1177): Xaa is Gln or Ser
  VARIANT (1178)..(1178): Xaa is Tyr or Val
  VARIANT (1180)..(1180): Xaa is Gln or Ser
  VARIANT (1185)..(1185): Xaa is Gln or Ser
  VARIANT (1186)..(1186): Xaa is Tyr or Val
  VARIANT (1188)..(1188): Xaa is Gln or Ser
  VARIANT (1193)..(1193): Xaa is Gln or Ser
  VARIANT (1194)..(1194): Xaa is Tyr or Val
  VARIANT (1196)..(1196): Xaa is Gln or Ser
  VARIANT (1201)..(1201): Xaa is Gln or Ser
  VARIANT (1202)..(1202): Xaa is Tyr or Val
  VARIANT (1204)..(1204): Xaa is Gln or Ser
  VARIANT (1209)..(1209): Xaa is Gln or Ser
  VARIANT (1210)..(1210): Xaa is Tyr or Val
  VARIANT (1212)..(1212): Xaa is Gln or Ser
  VARIANT (1217)..(1217): Xaa is Gln or Ser
  VARIANT (1218)..(1218): Xaa is Tyr or Val
  VARIANT (1220)..(1220): Xaa is Gln or Ser
  VARIANT (1225)..(1225): Xaa is Gln or Ser
  VARIANT (1226)..(1226): Xaa is Tyr or Val
  VARIANT (1228)..(1228): Xaa is Gln or Ser
  VARIANT (1233)..(1233): Xaa is Gln or Ser
  VARIANT (1234)..(1234): Xaa is Tyr or Val
  VARIANT (1236)..(1236): Xaa is Gln or Ser
  VARIANT (1241)..(1241): Xaa is Gln or Ser
  VARIANT (1242)..(1242): Xaa is Tyr or Val
  VARIANT (1244)..(1244): Xaa is Gln or Ser
  VARIANT (1249)..(1249): Xaa is Gln or Ser
  VARIANT (1250)..(1250): Xaa is Tyr or Val
  VARIANT (1252)..(1252): Xaa is Gln or Ser
  VARIANT (1257)..(1257): Xaa is Gln or Ser
  VARIANT (1258)..(1258): Xaa is Tyr or Val
  VARIANT (1260)..(1260): Xaa is Gln or Ser
  VARIANT (1265)..(1265): Xaa is Gln or Ser
  VARIANT (1266)..(1266): Xaa is Tyr or Val
  VARIANT (1268)..(1268): Xaa is Gln or Ser
  VARIANT (1273)..(1273): Xaa is Gln or Ser
  VARIANT (1274)..(1274): Xaa is Tyr or Val
  VARIANT (1276)..(1276): Xaa is Gln or Ser
XXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRG

SEQ ID NO: 154 - protein, 320 aa, Artificial Sequence
  Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQ

SEQ ID NO: 155 - protein, 400 aa, Artificial Sequence
  Elastin-like polypeptide
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 156 - protein, 720 aa, Artificial Sequence
  Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 157 - protein, 12 aa, Artificial Sequence
  linker
GKSSGSGSESKS

SEQ ID NO: 158 - protein, 14 aa, Artificial Sequence
  linker
GSTSGSGKSSEGKG

SEQ ID NO: 159 - protein, 18 aa, Artificial Sequence
  linker
GSTSGSGKSSEGSGSTKG

SEQ ID NO: 160 - protein, 18 aa, Artificial Sequence
  linker
GSTSGSGKPGSGEGSTKG

SEQ ID NO: 161 - protein, 14 aa, Artificial Sequence
  linker
EGKSSGSGSESKEF

SEQ ID NO: 162 - protein, 5 aa, Artificial Sequence
  linker
SRSSG

SEQ ID NO: 163 - protein, 5 aa, Artificial Sequence
  linker
SGSSC

SEQ ID NO: 164 - protein, 18 aa, Artificial Sequence
  linker
EGRGSLLTCGDVEENPGP

SEQ ID NO: 165 - protein, 19 aa, Artificial Sequence
  linker
ATNFSLLKQAGDVEENPGP

SEQ ID NO: 166 - protein, 20 aa, Artificial Sequence
  linker
QCTNYALLKLAGDVESNPGP

SEQ ID NO: 167 - protein, 22 aa, Artificial Sequence
  linker
VKQTLNFDLLKLAGDVESNPGP

SEQ ID NO: 168 - protein, 3 aa, Artificial Sequence
  linker
GSG

SEQ ID NO: 169 - protein, 96 aa, Homo sapiens
NRPPIAIVSPQFQEISLPTTSTVIDGSQSTDDDKIVQYHWEELKGPLREEKISEDTAILKLSKLVPGNYTFSLTVVDSDGATNSTTANLTVNKAVD

SEQ ID NO: 170 - protein, 400 aa, Artificial Sequence
  Elastin-like polypeptide
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 171 - protein, 505 aa, Artificial Sequence
  Purification Matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 172 - protein, 505 aa, Artificial Sequence
  Purification Matrix
MSKGPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 173 - protein, 505 aa, Artificial Sequence
  Purification Matrix
MSKGPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 174 - protein, 501 aa, Artificial Sequence
  Purification Matrix
MGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 175 - protein, 1800 aa, Artificial Sequence
  elastin-like polypeptide
  VARIANT (6)..(2500): May be present or absent in groups of the repeat unit Val Pro Gly Xaa Gly
  VARIANT (4)..(4): Xaa can be any naturally occurring amino acid except proline
  VARIANT (9)..(9): Xaa can be any naturally occurring amino acid except proline
  VARIANT (14)..(14): Xaa can be any naturally occurring amino acid except proline
  VARIANT (19)..(19): Xaa can be any naturally occurring amino acid except proline
  VARIANT (24)..(24): Xaa can be any naturally occurring amino acid except proline
  VARIANT (29)..(29): Xaa can be any naturally occurring amino acid except proline
  VARIANT (34)..(34): Xaa can be any naturally occurring amino acid except proline
  VARIANT (39)..(39): Xaa can be any naturally occurring amino acid except proline
  VARIANT (44)..(44): Xaa can be any naturally occurring amino acid except proline
  VARIANT (49)..(49): Xaa can be any naturally occurring amino acid except proline
  VARIANT (54)..(54): Xaa can be any naturally occurring amino acid except proline
  VARIANT (59)..(59): Xaa can be any naturally occurring amino acid except proline
  VARIANT (64)..(64): Xaa can be any naturally occurring amino acid except proline
  VARIANT (69)..(69): Xaa can be any naturally occurring amino acid except proline
  VARIANT (74)..(74): Xaa can be any naturally occurring amino acid except proline
  VARIANT (79)..(79): Xaa can be any naturally occurring amino acid except proline
  VARIANT (84)..(84): Xaa can be any naturally occurring amino acid except proline
  VARIANT (89)..(89): Xaa can be any naturally occurring amino acid except proline
  VARIANT (94)..(94): Xaa can be any naturally occurring amino acid except proline
  VARIANT (99)..(99): Xaa can be any naturally occurring amino acid except proline
  VARIANT (104)..(104): Xaa can be any naturally occurring amino acid except proline
  VARIANT (109)..(109): Xaa can be any naturally occurring amino acid except proline
  VARIANT (114)..(114): Xaa can be any naturally occurring amino acid except proline
  VARIANT (119)..(119): Xaa can be any naturally occurring amino acid except proline
  VARIANT (124)..(124): Xaa can be any naturally occurring amino acid except proline
  VARIANT (129)..(129): Xaa can be any naturally occurring amino acid except proline
  VARIANT (134)..(134): Xaa can be any naturally occurring amino acid except proline
  VARIANT (139)..(139): Xaa can be any naturally occurring amino acid except proline
  VARIANT (144)..(144): Xaa can be any naturally occurring amino acid except proline
  VARIANT (149)..(149): Xaa can be any naturally occurring amino acid except proline
  VARIANT (154)..(154): Xaa can be any naturally occurring amino acid except proline
  VARIANT (159)..(159): Xaa can be any naturally occurring amino acid except proline
  VARIANT (164)..(164): Xaa can be any naturally occurring amino acid except proline
  VARIANT (169)..(169): Xaa can be any naturally occurring amino acid except proline
  VARIANT (174)..(174): Xaa can be any naturally occurring amino acid except proline
  VARIANT (179)..(179): Xaa can be any naturally occurring amino acid except proline
  VARIANT (184)..(184): Xaa can be any naturally occurring amino acid except proline
  VARIANT (189)..(189): Xaa can be any naturally occurring amino acid except proline
  VARIANT (194)..(194): Xaa can be any naturally occurring amino acid except proline
  VARIANT (199)..(199): Xaa can be any naturally occurring amino acid except proline
  VARIANT (204)..(204): Xaa can be any naturally occurring amino acid except proline
  VARIANT (209)..(209): Xaa can be any naturally occurring amino acid except proline
  VARIANT (214)..(214): Xaa can be any naturally occurring amino acid except proline
  VARIANT (219)..(219): Xaa can be any naturally occurring amino acid except proline
  VARIANT (224)..(224): Xaa can be any naturally occurring amino acid except proline
  VARIANT (229)..(229): Xaa can be any naturally occurring amino acid except proline
  VARIANT (234)..(234): Xaa can be any naturally occurring amino acid except proline
  VARIANT (239)..(239): Xaa can be any naturally occurring amino acid except proline
  VARIANT (244)..(244): Xaa can be any naturally occurring amino acid except proline
  VARIANT (249)..(249): Xaa can be any naturally occurring amino acid except proline
  VARIANT (254)..(254): Xaa can be any naturally occurring amino acid except proline
  VARIANT (259)..(259): Xaa can be any naturally occurring amino acid except proline
  VARIANT (264)..(264): Xaa can be any naturally occurring amino acid except proline
  VARIANT (269)..(269): Xaa can be any naturally occurring amino acid except proline
  VARIANT (274)..(274): Xaa can be any naturally occurring amino acid except proline
  VARIANT (279)..(279): Xaa can be any naturally occurring amino acid except proline
  VARIANT (284)..(284): Xaa can be any naturally occurring amino acid except proline
  VARIANT (289)..(289): Xaa can be any naturally occurring amino acid except proline
  VARIANT (294)..(294): Xaa can be any naturally occurring amino acid except proline
  VARIANT (299)..(299): Xaa can be any naturally occurring amino acid except proline
  VARIANT (304)..(304): Xaa can be any naturally occurring amino acid except proline
  VARIANT (309)..(309): Xaa can be any naturally occurring amino acid except proline
  VARIANT (314)..(314): Xaa can be any naturally occurring amino acid except proline
  VARIANT (319)..(319): Xaa can be any naturally occurring amino acid except proline
  VARIANT (324)..(324): Xaa can be any naturally occurring amino acid except proline
  VARIANT (329)..(329): Xaa can be any naturally occurring amino acid except proline
  VARIANT (334)..(334): Xaa can be any naturally occurring amino acid except proline
  VARIANT (339)..(339): Xaa can be any naturally occurring amino acid except proline
  VARIANT (344)..(344): Xaa can be any naturally occurring amino acid except proline
  VARIANT (349)..(349): Xaa can be any naturally occurring amino acid except proline
  VARIANT (354)..(354): Xaa can be any naturally occurring amino acid except proline
  VARIANT (359)..(359): Xaa can be any naturally occurring amino acid except proline
  VARIANT (364)..(364): Xaa can be any naturally occurring amino acid except proline
  VARIANT (369)..(369): Xaa can be any naturally occurring amino acid except proline
  VARIANT (374)..(374): Xaa can be any naturally occurring amino acid except proline
  VARIANT (379)..(379): Xaa can be any naturally occurring amino acid except proline
  VARIANT (384)..(384): Xaa can be any naturally occurring amino acid except proline
  VARIANT (389)..(389): Xaa can be any naturally occurring amino acid except proline
  VARIANT (394)..(394): Xaa can be any naturally occurring amino acid except proline
  VARIANT (399)..(399): Xaa can be any naturally occurring amino acid except proline
  VARIANT (404)..(404): Xaa can be any naturally occurring amino acid except proline
  VARIANT (409)..(409): Xaa can be any naturally occurring amino acid except proline
  VARIANT (414)..(414): Xaa can be any naturally occurring amino acid except proline
  VARIANT (419)..(419): Xaa can be any naturally occurring amino acid except proline
  VARIANT (424)..(424): Xaa can be any naturally occurring amino acid except proline
  VARIANT (429)..(429): Xaa can be any naturally occurring amino acid except proline
  VARIANT (434)..(434): Xaa can be any naturally occurring amino acid except proline
  VARIANT (439)..(439): Xaa can be any naturally occurring amino acid except proline
  VARIANT (444)..(444): Xaa can be any naturally occurring amino acid except proline
  VARIANT (449)..(449): Xaa can be any naturally occurring amino acid except proline
  VARIANT (454)..(454): Xaa can be any naturally occurring amino acid except proline
  VARIANT (459)..(459): Xaa can be any naturally occurring amino acid except proline
  VARIANT (464)..(464): Xaa can be any naturally occurring amino acid except proline
  VARIANT (469)..(469): Xaa can be any naturally occurring amino acid except proline
  VARIANT (474)..(474): Xaa can be any naturally occurring amino acid except proline
  VARIANT (479)..(479): Xaa can be any naturally occurring amino acid except proline
  VARIANT (484)..(484): Xaa can be any naturally occurring amino acid except proline
  VARIANT (489)..(489): Xaa can be any naturally occurring amino acid except proline
  VARIANT (494)..(494): Xaa can be any naturally occurring amino acid except proline
  VARIANT (499)..(499): Xaa can be any naturally occurring amino acid except proline
  VARIANT (504)..(504): Xaa can be any naturally occurring amino acid except proline
  VARIANT (509)..(509): Xaa can be any naturally occurring amino acid except proline
  VARIANT (514)..(514): Xaa can be any naturally occurring amino acid except proline
  VARIANT (519)..(519): Xaa can be any naturally occurring amino acid except proline
  VARIANT (524)..(524): Xaa can be any naturally occurring amino acid except proline
  VARIANT (529)..(529): Xaa can be any naturally occurring amino acid except proline
  VARIANT (534)..(534): Xaa can be any naturally occurring amino acid except proline
  VARIANT (539)..(539): Xaa can be any naturally occurring amino acid except proline
  VARIANT (544)..(544): Xaa can be any naturally occurring amino acid except proline
  VARIANT (549)..(549): Xaa can be any naturally occurring amino acid except proline
  VARIANT (554)..(554): Xaa can be any naturally occurring amino acid except proline
  VARIANT (559)..(559): Xaa can be any naturally occurring amino acid except proline
  VARIANT (564)..(564): Xaa can be any naturally occurring amino acid except proline
  VARIANT (569)..(569): Xaa can be any naturally occurring amino acid except proline
  VARIANT (574)..(574): Xaa can be any naturally occurring amino acid except proline
  VARIANT (579)..(579): Xaa can be any naturally occurring amino acid except proline
  VARIANT (584)..(584): Xaa can be any naturally occurring amino acid except proline
  VARIANT (589)..(589): Xaa can be any naturally occurring amino acid except proline
  VARIANT (594)..(594): Xaa can be any naturally occurring amino acid except proline
  VARIANT (599)..(599): Xaa can be any naturally occurring amino acid except proline
  VARIANT (604)..(604): Xaa can be any naturally occurring amino acid except proline
  VARIANT (609)..(609): Xaa can be any naturally occurring amino acid except proline
  VARIANT (614)..(614): Xaa can be any naturally occurring amino acid except proline
  VARIANT (619)..(619): Xaa can be any naturally occurring amino acid except proline
  VARIANT (624)..(624): Xaa can be any naturally occurring amino acid except proline
  VARIANT (629)..(629): Xaa can be any naturally occurring amino acid except proline
  VARIANT (634)..(634): Xaa can be any naturally occurring amino acid except proline
  VARIANT (639)..(639): Xaa can be any naturally occurring amino acid except proline
  VARIANT (644)..(644): Xaa can be any naturally occurring amino acid except proline
  VARIANT (649)..(649): Xaa can be any naturally occurring amino acid except proline
  VARIANT (654)..(654): Xaa can be any naturally occurring amino acid except proline
  VARIANT (659)..(659): Xaa can be any naturally occurring amino acid except proline
  VARIANT (664)..(664): Xaa can be any naturally occurring amino acid except proline
  VARIANT (669)..(669): Xaa can be any naturally occurring amino acid except proline
  VARIANT (674)..(674): Xaa can be any naturally occurring amino acid except proline
  VARIANT (679)..(679): Xaa can be any naturally occurring amino acid except proline
  VARIANT (684)..(684): Xaa can be any naturally occurring amino acid except proline
  VARIANT (689)..(689): Xaa can be any naturally occurring amino acid except proline
  VARIANT (694)..(694): Xaa can be any naturally occurring amino acid except proline
  VARIANT (699)..(699): Xaa can be any naturally occurring amino acid except proline
  VARIANT (704)..(704): Xaa can be any naturally occurring amino acid except proline
  VARIANT (709)..(709): Xaa can be any naturally occurring amino acid except proline
  VARIANT (714)..(714): Xaa can be any naturally occurring amino acid except proline
  VARIANT (719)..(719): Xaa can be any naturally occurring amino acid except proline
  VARIANT (724)..(724): Xaa can be any naturally occurring amino acid except proline
  VARIANT (729)..(729): Xaa can be any naturally occurring amino acid except proline
  VARIANT (734)..(734): Xaa can be any naturally occurring amino acid except proline
  VARIANT (739)..(739): Xaa can be any naturally occurring amino acid except proline
  VARIANT (744)..(744): Xaa can be any naturally occurring amino acid except proline
  VARIANT (749)..(749): Xaa can be any naturally occurring amino acid except proline
  VARIANT (754)..(754): Xaa can be any naturally occurring amino acid except proline
  VARIANT (759)..(759): Xaa can be any naturally occurring amino acid except proline
  VARIANT (764)..(764): Xaa can be any naturally occurring amino acid except proline
  VARIANT (769)..(769): Xaa can be any naturally occurring amino acid except proline
  VARIANT (774)..(774): Xaa can be any naturally occurring amino acid except proline
  VARIANT (779)..(779): Xaa can be any naturally occurring amino acid except proline
  VARIANT (784)..(784): Xaa can be any naturally occurring amino acid except proline
  VARIANT (789)..(789): Xaa can be any naturally occurring amino acid except proline
  VARIANT (794)..(794): Xaa can be any naturally occurring amino acid except proline
  VARIANT (799)..(799): Xaa can be any naturally occurring amino acid except proline
  VARIANT (804)..(804): Xaa can be any naturally occurring amino acid except proline
  VARIANT (809)..(809): Xaa can be any naturally occurring amino acid except proline
  VARIANT (814)..(814): Xaa can be any naturally occurring amino acid except proline
  VARIANT (819)..(819): Xaa can be any naturally occurring amino acid except proline
  VARIANT (824)..(824): Xaa can be any naturally occurring amino acid except proline
  VARIANT (829)..(829): Xaa can be any naturally occurring amino acid except proline
  VARIANT (834)..(834): Xaa can be any naturally occurring amino acid except proline
  VARIANT (839)..(839): Xaa can be any naturally occurring amino acid except proline
  VARIANT (844)..(844): Xaa can be any naturally occurring amino acid except proline
  VARIANT (849)..(849): Xaa can be any naturally occurring amino acid except proline
  VARIANT (854)..(854): Xaa can be any naturally occurring amino acid except proline
  VARIANT (859)..(859): Xaa can be any naturally occurring amino acid except proline
  VARIANT (864)..(864): Xaa can be any naturally occurring amino acid except proline
  VARIANT (869)..(869): Xaa can be any naturally occurring amino acid except proline
  VARIANT (874)..(874): Xaa can be any naturally occurring amino acid except proline
  VARIANT (879)..(879): Xaa can be any naturally occurring amino acid except proline
  VARIANT (884)..(884): Xaa can be any naturally occurring amino acid except proline
  VARIANT (889)..(889): Xaa can be any naturally occurring amino acid except proline
  VARIANT (894)..(894): Xaa can be any naturally occurring amino acid except proline
  VARIANT (899)..(899): Xaa can be any naturally occurring amino acid except proline
  VARIANT (904)..(904): Xaa can be any naturally occurring amino acid except proline
  VARIANT (909)..(909): Xaa can be any naturally occurring amino acid except proline
  VARIANT (914)..(914): Xaa can be any naturally occurring amino acid except proline
  VARIANT (919)..(919): Xaa can be any naturally occurring amino acid except proline
  VARIANT (924)..(924): Xaa can be any naturally occurring amino acid except proline
  VARIANT (929)..(929): Xaa can be any naturally occurring amino acid except proline
  VARIANT (934)..(934): Xaa can be any naturally occurring amino acid except proline
  VARIANT (939)..(939): Xaa can be any naturally occurring amino acid except proline
  VARIANT (944)..(944): Xaa can be any naturally occurring amino acid except proline
  VARIANT (949)..(949): Xaa can be any naturally occurring amino acid except proline
  VARIANT (954)..(954): Xaa can be any naturally occurring amino acid except proline
  VARIANT (959)..(959): Xaa can be any naturally occurring amino acid except proline
  VARIANT (964)..(964): Xaa can be any naturally occurring amino acid except proline
  VARIANT (969)..(969): Xaa can be any naturally occurring amino acid except proline
  VARIANT (974)..(974): Xaa can be any naturally occurring amino acid except proline
  VARIANT (979)..(979): Xaa can be any naturally occurring amino acid except proline
  VARIANT (984)..(984): Xaa can be any naturally occurring amino acid except proline
  VARIANT (989)..(989): Xaa can be any naturally occurring amino acid except proline
  VARIANT (994)..(994): Xaa can be any naturally occurring amino acid except proline
  VARIANT (999)..(999): Xaa can be any naturally occurring amino acid except proline
  VARIANT (1004)..(1004): Xaa can be any naturally occurring amino acid except proline
  VARIANT (1009)..(1009): Xaa can be any naturally occurring amino acid except proline
  VARIANT (1014)..(1014): Xaa can be any naturally occurring amino acid except proline
  VARIANT (1019)..(1019): Xaa can be any naturally occurring amino acid except proline
  VARIANT (1024)..(1024): Xaa can be any naturally occurring amino acid except proline
  VARIANT (1029)..(1029): Xaa can be any naturally occurring amino acid except proline
  VARIANT (1034)..(1034): Xaa can be any naturally occurring amino acid except proline
  VARIANT (1039)..(1039): Xaa can be any naturally occurring amino acid except proline
  VARIANT (1044)..(1044): Xaa can be any naturally occurring amino acid except proline
  VARIANT (1049)..(1049): Xaa can be any naturally occurring amino acid except proline
  VARIANT (1054)..(1054): Xaa can be any naturally occurring amino acid except proline
  VARIANT (1059)..(1059): Xaa can be any naturally occurring amino acid except proline
  VARIANT (1064)..(1064): Xaa can be any naturally occurring amino acid except proline
  VARIANT (1069)..(1069): Xaa can be any naturally occurring amino acid except proline
  VARIANT (1074)..(1074): Xaa can be any naturally occurring amino acid except proline
  VARIANT (1079)..(1079): Xaa can be any naturally occurring amino acid except proline
  VARIANT (1084)..(1084): Xaa can be any naturally occurring amino acid except proline
  VARIANT (1089)..(1089): Xaa can be any naturally occurring amino acid except proline
  VARIANT (1094)..(1094): Xaa can be any naturally occurring amino acid except proline
  VARIANT (1099)..(1099): Xaa can be any naturally occurring amino acid except proline
  VARIANT (1104)..(1104): Xaa can be any naturally occurring amino acid except proline
  VARIANT (1109)..(1109): Xaa can be any naturally occurring amino acid except proline
  VARIANT (1114)..(1114): Xaa can be any naturally occurring amino acid except proline
  VARIANT (1119)..(1119): Xaa can be any naturally occurring amino acid except proline
  VARIANT (1124)..(1124): Xaa can be any naturally occurring amino acid except proline
  VARIANT (1129)..(1129): Xaa can be any naturally occurring amino acid except proline
  VARIANT (1134)..(1134): Xaa can be any naturally occurring amino acid except proline
  VARIANT (1139)..(1139): Xaa can be any naturally occurring amino acid except proline
  VARIANT (1144)..(1144): Xaa can be any naturally occurring amino acid except proline
  VARIANT (1149)..(1149): Xaa can be any naturally occurring amino acid except proline
  VARIANT (1154)..(1154): Xaa can be any naturally occurring amino acid except proline
  VARIANT (1159)..(1159): Xaa can be any naturally occurring amino acid except proline
  VARIANT (1164)..(1164): Xaa can be any naturally occurring amino acid except proline
  VARIANT (1169)..(1169): Xaa can be any naturally occurring amino acid except proline
  VARIANT (1174)..(1174): Xaa can be any naturally occurring amino acid except proline
  VARIANT (1179)..(1179): Xaa can be any naturally occurring amino acid except proline
  VARIANT (1184)..(1184): Xaa can be any naturally occurring amino acid except proline
  VARIANT (1189)..(1189): Xaa can be any naturally occurring amino acid except proline
  VARIANT (1194)..(1194): Xaa can be any naturally occurring amino acid except proline
  VARIANT (1199)..(1199): Xaa can be any naturally occurring amino acid except proline
  VARIANT (1204)..(1204): Xaa can be any naturally occurring amino acid except proline
  VARIANT (1209)..(1209): Xaa can be any naturally occurring amino acid except proline
  VARIANT (1214)..(1214): Xaa can be any naturally occurring amino acid except proline
  VARIANT (1219)..(1219): Xaa can be any naturally occurring amino acid except proline
  VARIANT (1224)..(1224): Xaa can be any naturally occurring amino acid except proline
  VARIANT (1229)..(1229): Xaa can be any naturally occurring amino acid except proline
  VARIANT (1234)..(1234): Xaa can be any naturally occurring amino acid except proline
  VARIANT (1239)..(1239): Xaa can be any naturally occurring amino acid except proline
  VARIANT (1244)..(1244): Xaa can be any naturally occurring amino acid except proline
  VARIANT (1249)..(1249): Xaa can be any naturally occurring amino acid except proline
  VARIANT (1254)..(1254): Xaa can be any naturally occurring amino acid except proline
  VARIANT (1259)..(1259): Xaa can be any naturally occurring amino acid except proline
  VARIANT (1264)..(1264): Xaa can be any naturally occurring amino acid except proline
  VARIANT (1269)..(1269): Xaa can be any naturally occurring amino acid except proline
  VARIANT (1274)..(1274): Xaa can be any naturally occurring amino acid except proline
  VARIANT (1279)..(1279): Xaa can be any naturally occurring amino acid except proline
  VARIANT (1284)..(1284): Xaa can be any naturally occurring amino acid except proline
  VARIANT (1289)..(1289): Xaa can be any naturally occurring amino acid except proline
  VARIANT (1294)..(1294): Xaa can be any naturally occurring amino acid except proline
  VARIANT (1299)..(1299): Xaa can be any naturally occurring amino acid except proline
  VARIANT (1304)..(1304): Xaa can be any naturally occurring amino acid except proline
  VARIANT (1309)..(1309): Xaa can be any naturally occurring amino acid except proline
  VARIANT (1314)..(1314): Xaa can be any naturally occurring amino acid except proline
  VARIANT (1319)..(1319): Xaa can be any naturally occurring amino acid except proline
  VARIANT (1324)..(1324): Xaa can be any naturally occurring amino acid except proline
  VARIANT (1329)..(1329): Xaa can be any naturally occurring amino acid except proline
  VARIANT (1334)..(1334): Xaa can be any naturally occurring amino acid except proline
  VARIANT (1339)..(1339): Xaa can be any naturally occurring amino acid except proline
  VARIANT (1344)..(1344): Xaa can be any naturally occurring amino acid except proline
  VARIANT (1349)..(1349): Xaa can be any naturally occurring amino acid except proline
  VARIANT (1354)..(1354): Xaa can be any naturally occurring amino acid except proline
  VARIANT (1359)..(1359): Xaa can be any naturally occurring amino acid except proline
  VARIANT (1364)..(1364): Xaa can be any naturally occurring amino acid except proline
  VARIANT (1369)..(1369): Xaa can be any naturally occurring amino acid except proline
  VARIANT (1374)..(1374): Xaa can be any naturally occurring amino acid except proline
  VARIANT (1379)..(1379): Xaa can be any naturally occurring amino acid except proline
  VARIANT (1384)..(1384): Xaa can be any naturally occurring amino acid except proline
  VARIANT (1389)..(1389): Xaa can be any naturally occurring amino acid except proline
  VARIANT (1394)..(1394): Xaa can be any naturally occurring amino acid except proline
  VARIANT (1399)..(1399): Xaa can be any naturally occurring amino acid except proline
  VARIANT (1404)..(1404): Xaa can be any naturally occurring amino acid except proline
  VARIANT (1409)..(1409): Xaa can be any naturally occurring amino acid except proline
  VARIANT (1414)..(1414): Xaa can be any naturally occurring amino acid except proline
  VARIANT (1419)..(1419): Xaa can be any naturally occurring amino acid except proline
  VARIANT (1424)..(1424): Xaa can be any naturally occurring amino acid except proline
  VARIANT (1429)..(1429): Xaa can be any naturally occurring amino acid except proline
  VARIANT (1434)..(1434): Xaa can be any naturally occurring amino acid except proline
  VARIANT (1439)..(1439): Xaa can be any naturally occurring amino acid except proline
  VARIANT (1444)..(1444): Xaa can be any naturally occurring amino acid except proline
  VARIANT (1449)..(1449): Xaa can be any naturally occurring amino acid except proline
  VARIANT (1454)..(1454): Xaa can be any naturally occurring amino acid except proline
  VARIANT (1459)..(1459): Xaa can be any naturally occurring amino acid except proline
  VARIANT (1464)..(1464): Xaa can be any naturally occurring amino acid except proline
  VARIANT (1469)..(1469): Xaa can be any naturally occurring amino acid except proline
  VARIANT (1474)..(1474): Xaa can be any naturally occurring amino acid except proline
  VARIANT (1479)..(1479): Xaa can be any naturally occurring amino acid except proline
  VARIANT (1484)..(1484): Xaa can be any naturally occurring amino acid except proline
  VARIANT (1489)..(1489): Xaa can be any naturally occurring amino acid except proline
  VARIANT (1494)..(1494): Xaa can be any naturally occurring amino acid except proline
  VARIANT (1499)..(1499): Xaa can be any naturally occurring amino acid except proline
  VARIANT (1504)..(1504): Xaa can be any naturally occurring amino acid except proline
  VARIANT (1509)..(1509): Xaa can be any naturally occurring amino acid except proline
  VARIANT (1514)..(1514): Xaa can be any naturally occurring amino acid except proline
  VARIANT (1519)..(1519): Xaa can be any naturally occurring amino acid except proline
  VARIANT (1524)..(1524): Xaa can be any naturally occurring amino acid except proline
  VARIANT (1529)..(1529): Xaa can be any naturally occurring amino acid except proline
  VARIANT (1534)..(1534): Xaa can be any naturally occurring amino acid except proline
  VARIANT (1539)..(1539): Xaa can be any naturally occurring amino acid except proline
  VARIANT (1544)..(1544): Xaa can be any naturally occurring amino acid except proline
  VARIANT (1549)..(1549): Xaa can be any naturally occurring amino acid except proline
  VARIANT (1554)..(1554): Xaa can be any naturally occurring amino acid except proline
  VARIANT (1559)..(1559): Xaa can be any naturally occurring amino acid except proline
  VARIANT (1564)..(1564): Xaa can be any naturally occurring amino acid except proline
  VARIANT (1569)..(1569): Xaa can be any naturally occurring amino acid except proline
  VARIANT (1574)..(1574): Xaa can be any naturally occurring amino acid except proline
  VARIANT (1579)..(1579): Xaa can be any naturally occurring amino acid except proline
  VARIANT (1584)..(1584): Xaa can be any naturally occurring amino acid except proline
  VARIANT (1589)..(1589): Xaa can be any naturally occurring amino acid except proline
  VARIANT (1594)..(1594): Xaa can be any naturally occurring amino acid except proline
  VARIANT (1599)..(1599): Xaa can be any naturally occurring amino acid except proline
  VARIANT (1604)..(1604): Xaa can be any naturally occurring amino acid except proline
  VARIANT (1609)..(1609): Xaa can be any naturally occurring amino acid except proline
  VARIANT (1614)..(1614): Xaa can be any naturally occurring amino acid except proline
  VARIANT (1619)..(1619): Xaa can be any naturally occurring amino acid except proline
  VARIANT (1624)..(1624): Xaa can be any naturally occurring amino acid except proline
  VARIANT (1629)..(1629): Xaa can be any naturally occurring amino acid except proline
  VARIANT (1634)..(1634): Xaa can be any naturally occurring amino acid except proline
  VARIANT (1639)..(1639): Xaa can be any naturally occurring amino acid except proline
  VARIANT (1644)..(1644): Xaa can be any naturally occurring amino acid except proline
  VARIANT (1649)..(1649): Xaa can be any naturally occurring amino acid except proline
  VARIANT (1654)..(1654): Xaa can be any naturally occurring amino acid except proline
  VARIANT (1659)..(1659): Xaa can be any naturally occurring amino acid except proline
  VARIANT (1664)..(1664): Xaa can be any naturally occurring amino acid except proline
  VARIANT (1669)..(1669): Xaa can be any naturally occurring amino acid except proline
  VARIANT (1674)..(1674): Xaa can be any naturally occurring amino acid except proline
  VARIANT (1679)..(1679): Xaa can be any naturally occurring amino acid except proline
  VARIANT (1684)..(1684): Xaa can be any naturally occurring amino acid except proline
  VARIANT (1689)..(1689): Xaa can be any naturally occurring amino acid except proline
  VARIANT (1694)..(1694): Xaa can be any naturally occurring amino acid except proline
  VARIANT (1699)..(1699): Xaa can be any naturally occurring amino acid except proline
  VARIANT (1704)..(1704): Xaa can be any naturally occurring amino acid except proline
  VARIANT (1709)..(1709): Xaa can be any naturally occurring amino acid except proline
  VARIANT (1714)..(1714): Xaa can be any naturally occurring amino acid except proline
  VARIANT (1719)..(1719): Xaa can be any naturally occurring amino acid except proline
  VARIANT (1724)..(1724): Xaa can be any naturally occurring amino acid except proline
  VARIANT (1729)..(1729): Xaa can be any naturally occurring amino acid except proline
  VARIANT (1734)..(1734): Xaa can be any naturally occurring amino acid except proline
  VARIANT (1739)..(1739): Xaa can be any naturally occurring amino acid except proline
  VARIANT (1744)..(1744): Xaa can be any naturally occurring amino acid except proline
  VARIANT (1749)..(1749): Xaa can be any naturally occurring amino acid except proline
  VARIANT (1754)..(1754): Xaa can be any naturally occurring amino acid except proline
  VARIANT (1759)..(1759): Xaa can be any naturally occurring amino acid except proline
  VARIANT (1764)..(1764): Xaa can be any naturally occurring amino acid except proline
  VARIANT (1769)..(1769): Xaa can be any naturally occurring amino acid except proline
  VARIANT (1774)..(1774): Xaa can be any naturally occurring amino acid except proline
  VARIANT (1779)..(1779): Xaa can be any naturally occurring amino acid except proline
  VARIANT (1784)..(1784): Xaa can be any naturally occurring amino acid except proline
  VARIANT (1789)..(1789): Xaa can be any naturally occurring amino acid except proline
  VARIANT (1794)..(1794): Xaa can be any naturally occurring amino acid except proline
  VARIANT (1799)..(1799): Xaa can be any naturally occurring amino acid except proline
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

What is claimed is:

1. A fusion protein comprising an AAV-binding polypeptide and a polypeptide having phase behavior, wherein the AAV-binding polypeptide comprises the amino acid sequence of SEQ ID NO: 52.

2. The fusion protein of claim 1, wherein the polypeptide with phase behavior is an elastin-like polypeptide.

3. The fusion protein of claim 1, wherein the polypeptide with phase behavior is selected from the group consisting of:

(i) a pentapeptide repeat having the sequence (Val-Pro-Gly-Xaa-Gly)$_n$ (SEQ ID NO: 175); wherein Xaa can be any amino acid except proline, wherein n is an integer between 1 and 360, inclusive of endpoints;

(ii) (GRGDSPY)$_n$ (SEQ ID NO: 1), wherein n is an integer in the range of 20-360;

(iii) (GRGDSPH)$_n$ (SEQ ID NO: 2), wherein n is an integer in the range of 20-360;

(iv) (GRGDSPV)$_n$ (SEQ ID NO: 3), wherein n is an integer in the range of 20-360;

(v) (GRGDSPYG)$_n$ (SEQ ID NO: 4), wherein n is an integer in the range of 20-360;

(vi) (RPLGYDS)$_n$ (SEQ ID NO: 5), wherein n is an integer in the range of 20-360;

(vii) (RPAGYDS)$_n$ (SEQ ID NO: 6), wherein n is an integer in the range of 20-360;

(viii) (ZZPXXXXGZ)$_m$ (SEQ ID NO: 148), wherein m is an integer in the range of 4-25;

(ix) (GRGDSYP)$_n$ (SEQ ID NO: 7), wherein n is an integer in the range of 20-360;

(x) (GRGDSPYQ)$_n$ (SEQ ID NO: 8), wherein n is an integer in the range of 20-360;

(xi) (GRGNSPYG)$_n$ (SEQ ID NO: 9), wherein n is an integer in the range of 20-360;

(xii) (GVGVP)$_n$ (SEQ ID NO: 11), wherein n is an integer in the range of 20-360;

(xiii) (GVGVPGLGVPGVGVPGLGVPGVGVP)$_m$ (SEQ ID NO: 12), wherein m is an integer in the range of 4-25;

(xiv) (GVGVPGVGVPGAGVPGVGVPGVGVP)$_m$ (SEQ ID NO: 13), wherein m is an integer in the range of 4-25;

(XV) (GVGVPGWGVPGVGVPGWGVPGVGVP)$_m$ (SEQ ID NO: 14), wherein m is an integer in the range of 4-25;

(xvi) (GVGVPGVGVPGVGVPGVGVPGVGVPGVG VPGEGVPGFGVPGVGVP)$_m$ (SEQ ID NO: 15), wherein m is an integer in the range of 4-25;

(xvii) (GVGVPGVGVPGVGVPGVGVPGVGVPGVG VPGKGVPGFGVPGVGVP)$_m$ (SEQ ID NO: 16), wherein m is an integer in the range of 4-25;

(xviii) (GAGVPGVGVPGAGVPGVGVPGAGVP)$_m$ (SEQ ID NO: 17), wherein m is an integer in the range of 4-25;

(xix) (GVGVP)$_m$ (SEQ ID NO: 143), wherein m is an integer between 10 and 160, inclusive of endpoints;

(xx) (ZZPXGZ)$_m$ (SEQ ID NO: 149), wherein m is an integer between 10 and 160, inclusive of endpoints, wherein X if present is any amino acid except proline or glycine, and wherein Z if present is any amino acid;

(xxi) (ZZPXXGZ)$_m$ (SEQ ID NO: 150), wherein m is an integer between 10 and 160, inclusive of endpoints, wherein X if present is any amino acid except proline or glycine, and wherein Z if present is any amino acid;

(xxii) (ZZPXXXGZ)$_m$ (SEQ ID NO: 151), wherein m is an integer between 10 and 160, inclusive of endpoints, wherein X if present is any amino acid except proline or glycine, and wherein Z if present is any amino acid;

(xxiii) (GVGVPGVGVPGAGVPGVGVPGVGVP)$_m$ (SEQ ID NO: 144), wherein m is an integer between 2 and 32, inclusive of endpoints;

(xxiv) (GVGVPGVGVPGLGVPGVGVPGVGVP)$_m$ (SEQ ID NO: 146), wherein m is an integer between 2 and 32, inclusive of endpoints;

(XXV) (GVGVPGVGVPGAGVPGVGVPGVGVP)$_m$ (SEQ ID NO: 144), wherein m is 8 or 16;

(xxvi) (GVGVPGAGVP)$_m$ (SEQ ID NO: 145), wherein m is an integer between 5 and 80, inclusive of endpoints; and (xxvii) (GXGVP)$_m$ (SEQ ID NO: 147), wherein m is an integer between 10 and 160, inclusive of endpoints, wherein X for each repeat is independently selected from the group consisting of glycine, alanine, valine, isoleucine, leucine, phenylalanine, tyrosine, tryptophan, lysine, arginine, aspartic acid, glutamic acid, and serine.

4. The fusion protein of claim 1, wherein the polypeptide with phase behavior comprises the sequence of (GVGVPGLGVPGVGVPGLGVPGVGVP)$_m$, wherein m is 16 (SEQ ID NO: 12).

5. The fusion protein of claim 1, comprising the amino acid sequence of SEQ ID NO: 174.

6. A method for purifying an AAV particle, the method comprising: (i) contacting the AAV particle with the fusion protein of claim 1, wherein the AAV particle and fusion protein associate to form a complex; (ii) contacting the fusion protein with a first environmental factor to increase the size of the complex; (iii) separating the complex from at least one contaminant; and (iv) eluting the AAV particle from the complex by applying a second environmental factor.

7. The method of claim 6, wherein the AAV particle comprises a capsid protein of any one of the following serotypes: AAV1, AAV2, AAV3, AAV4, AAV5, AAV6, AAV7, AAV8, AAV9, AAV10, AAV11, AAV12, AAVrh8, AAVrh10, AAVrh32.33, AAVrh74, Avian AAV or Bovine AAV.

8. The method of claim 6,
wherein the first environmental factor comprises one or
   more of:
   (a) a change in one or more of temperature, pH, salt
      concentration or pressure;
   (b) the addition of one or more surfactants, cofactors,
      vitamins, molecular crowding agents, enzymes,
      denaturing agents; and
   (c) the application of electromagnetic or acoustic
      waves.

9. The method of claim 6, comprising separating the from
at least one impurity on the basis of size using a technique
selected from the group consisting of tangential flow filtra-
tion, analytical ultracentrifugation, membrane chromatogra-
phy, high performance liquid chromatography, normal flow
filtration, acoustic wave separation, centrifugation, counter-
flow centrifugation, and fast protein liquid chromatography.

10. The method of claim 6, wherein the second environ-
mental factor comprises one or more of:
   (a) a change in one or more of temperature, pH, salt
      concentration or pressure;
   (b) the addition of one or more surfactants, cofactors,
      vitamins, molecular crowding agents, denaturing
      agents, enzymes; and
   (c) the application of electromagnetic or acoustic waves.

11. A method of stabilizing AAV particles during purifi-
cation thereof, the method comprising contacting the AAV
particles with the fusion protein of claim 1 during purifica-
tion thereof.

\* \* \* \* \*